US012084687B2

(12) United States Patent
Fong et al.

(10) Patent No.: US 12,084,687 B2
(45) Date of Patent: Sep. 10, 2024

(54) CHIMERIC POXVIRUS COMPOSITIONS AND USES THEREOF

(71) Applicant: CITY OF HOPE, Duarte, CA (US)

(72) Inventors: Yuman Fong, La Canada, CA (US); Nanhai Chen, San Diego, CA (US)

(73) Assignee: CITY OF HOPE, Duarte, CA (US)

( * ) Notice: Subject to any disclaimer, the term of this patent is extended or adjusted under 35 U.S.C. 154(b) by 1097 days.

(21) Appl. No.: 16/324,541

(22) PCT Filed: Aug. 9, 2017

(86) PCT No.: PCT/US2017/046163

§ 371 (c)(1),
(2) Date: Feb. 8, 2019

(87) PCT Pub. No.: WO2018/031694

PCT Pub. Date: Feb. 15, 2018

(65) Prior Publication Data

US 2019/0218522 A1 Jul. 18, 2019

Related U.S. Application Data

(60) Provisional application No. 62/519,010, filed on Jun. 13, 2017, provisional application No. 62/372,408, filed on Aug. 9, 2016.

(51) Int. Cl.

| | |
|---|---|
| ***C12N 7/00*** | (2006.01) |
| ***A61K 35/76*** | (2015.01) |
| ***A61K 39/275*** | (2006.01) |
| ***A61P 35/00*** | (2006.01) |
| ***C07K 14/47*** | (2006.01) |
| ***C07K 16/28*** | (2006.01) |
| ***C12N 15/86*** | (2006.01) |

(52) U.S. Cl.

CPC ................ *C12N 7/00* (2013.01); *A61K 35/76* (2013.01); *A61K 39/275* (2013.01); *A61P 35/00* (2018.01); *C07K 14/47* (2013.01); *C07K 16/2827* (2013.01); *C12N 15/86* (2013.01); *C07K 2317/565* (2013.01); *C07K 2317/74* (2013.01); *C07K 2317/76* (2013.01); *C12N 2710/24121* (2013.01); *C12N 2710/24132* (2013.01); *C12N 2710/24143* (2013.01); *C12N 2710/24151* (2013.01)

(58) Field of Classification Search

None

See application file for complete search history.

(56) References Cited

U.S. PATENT DOCUMENTS

| | | | |
|---|---|---|---|
| 6,352,856 | B1 | 3/2002 | Falkner et al. |
| 2003/0022157 | A1 | 1/2003 | Zauderer et al. |
| 2012/0308484 | A1 | 12/2012 | Szalay et al. |
| 2013/0071430 | A1 | 3/2013 | Nakamura et al. |
| 2013/0323201 | A1 | 12/2013 | Wise et al. |
| 2015/0175976 | A1 | 6/2015 | Szalay et al. |

FOREIGN PATENT DOCUMENTS

| | | | |
|---|---|---|---|
| WO | WO-2015/103438 | A2 | 7/2015 |
| WO | WO-2015/103438 | A3 | 7/2015 |

OTHER PUBLICATIONS

Anderson, B.D. et al. (Jul. 15, 2004). “High CD46 receptor density determines preferential killing of tumor cells by oncolytic measles virus,” *Cancer Res* 64(14):4919-4926.

Andtbacka, R.H. et al. (Sep. 1, 2015, e-published May 26, 2015). “Talimogene Laherparepvec Improves Durable Response Rate in Patients With Advanced Melanoma,” *J Clin Oncol* 33(25):2780-2788.

Benencia, F. et al. (Nov. 2005, e-published May 31, 2005). “HSV oncolytic therapy upregulates interferon-inducible chemokines and recruits immune effector cells in ovarian cancer,” *Mol Ther* 12(5):789-802.

Chan, W.M. et al. (Sep. 1, 2014). “Oncolytic Poxviruses,” *Annu Rev Virol* 1(1):119-141.

Chen, A.Y. et al. (Nov. 2010). “Parvovirus infection-induced cell death and cell cycle arrest,” *Future Virol* 5(6):731-743.

Chen, N.G. et al. (2011). “Cancer Management in Man: Chemotherapy, Biological Therapy, Hyperthermia, and Supporting Measures,” in *Cancer Growth and Progression* Soringer, New York, 13:295-316.

Curigliano, G. et al. (2011). “The triple-negative subtype: new ideas for the poorest prognosis breast cancer,” *J Natl Cancer Inst Monogr* 2011(43):108-110.

Evgin, L. et al. (May 2010, e-published Feb. 16, 2010). “Potent oncolytic activity of raccoonpox virus in the absence of natural pathogenicity,” *Mol Ther* 18(5):896-902.

Falkner, F.G. et al. (Jun. 1990). “Transient dominant selection of recombinant vaccinia viruses,” *J Virol* 64(6):3108-3111.

Friebe, A. et al. (Jul. 2011, e-published Feb. 23, 2011). “Characterization of immunostimulatory components of orf virus (parapoxvirus ovis),” *J Gen Virol* 92(Pt 7):1571-1584.

Gauvrit, A. et al. (Jun. 15, 2008). “Measles virus induces oncolysis of mesothelioma cells and allows dendritic cells to cross-prime tumor-specific CD8 response,” *Cancer Res* 68(12):4882-4892.

GenBank AY243312.1, (Mar. 14, 2006). 78 pages.

Gholami, S. et al. (Dec. 2014, e-published Nov. 13, 2014). “A novel vaccinia virus with dual oncolytic and anti-angiogenic therapeutic effects against triple-negative breast cancer,” *Breast Cancer Res Treat* 148(3):489-499.

International Search Report dated Dec. 19, 2017, for PCT Application No. PCT/US2017/046163, filed Aug. 9, 2017, 6 pages.

Kaufman, H.L. et al. (Sep. 2015). “Oncolytic viruses: a new class of immunotherapy drugs,” *Nat Rev Drug Discov* 14(9):642-662.

(Continued)

*Primary Examiner* — Nicole Kinsey White

(57) ABSTRACT

Provided herein are, inter alia, viral compositions and methods of using the same. The viral compositions provided include, inter alia, therapeutically effective amounts of a chimeric poxvirus and are particularly useful for methods of treating cancer. The chimeric poxviruses provided herein may further include transgenes.

27 Claims, 94 Drawing Sheets

Specification includes a Sequence Listing.

(56) References Cited

OTHER PUBLICATIONS

Migali, C. et al. (Sep. 2016, e-published Jul. 10, 2016). "Strategies to modulate the immune system in breast cancer: checkpoint inhibitors and beyond," *Ther Adv Med Oncol* 8(5):360-374.

Rintoul, J.L. et al. (Jun. 2012, e-published Jan. 24, 2012). "ORFV: a novel oncolytic and immune stimulating parapoxvirus therapeutic," *Mol Ther* 20(6):1148-1157.

Russell, S.J. et al. (Jul. 10, 2012). "Oncolytic virotherapy," *Nat Biotechnol* 30(7):658-670.

Thorne, S.H .et al. (Nov. 2007). "Rational strain selection and engineering creates a broad-spectrum, systemically effective oncolytic poxvirus, JX-963," *J Clin Invest* 117(11):3350-3358.

Written Opinion dated Dec. 19, 2017, for PCT Application No. PCT/US2017/046163, filed Aug. 9, 2017, 8 pages.

Antoine, G. et al. (May 10, 1998). "The complete genomic sequence of the modified vaccinia Ankara strain: comparison with other orthopoxviruses," *Virology* 244(2):365-396.

Extended European Search Report dated Jun. 26, 2020, for EP Patent Application No. 17840232.7, 12 pages.

Mercer, A.A. et al. (Mar. 3, 1997). "A novel strategy for determining protective antigens of the parapoxvirus, orf virus," *Virology* 229(1):193-200.

Partial Supplementary European Search Report dated Jan. 30, 2020, for EP Patent Application No. 17840232.7, 13 pages.

O'Leary, M.P. et al. (Mar. 22, 2018, e-published Jun. 29, 2018). "A Novel Oncolytic Chimeric Orthopoxvirus Encoding Luciferase Enables Real-Time View of Colorectal Cancer Cell Infection," *Mol Ther Oncolytics* 9:13-21.

Qin, L. et al. (May 2014, e-published Feb. 26, 2014). "Genome scale patterns of recombination between coinfecting vaccinia viruses," *J Virol* 88(10):5277-5286.

Woodroofe, G.M. et al. (Oct. 1960). "Genetic studies with mammalian poxviruses. IV. Hybridization between several different poxviruses," *Virology* 12:272-282.

Ando, N. et al. (Dec. 1968). "Genetic recombination between vaccinia virus strains distinct in hemagglutinin production and plaquing efficiency," *Jpn J. Microbiol* 12(4):495-504.

Blasco, R. et al. (Jun. 1993). "Dissociation of progeny vaccinia virus from the cell membrane is regulated by a viral envelope glycoprotein: effect of a point mutation in the lectin homology domain of the A34R gene," *Journal of Virology* 67(6):3319-3325.

Chaurasiya, S. et al. (Apr. 2020, e-published Jun. 17, 2019). "A chimeric poxvirus with J2R (thymidine kinase) deletion shows safety and anti-tumor activity in lung cancer models," *Cancer Gene Therapy* 27(3-4):125-135.

Chaurasiya, S. et al. (Mar. 2022). "A comprehensive preclinical study supporting clinical trial of oncolytic chimeric poxvirus CF33-hNIS-anti-PD-L1 to treat breast cancer," Molecular Therapy: Methods & Clinical Development 24:102-116.

Dumbell, K.R. et al. (1964). "The use of ceiling temperature and reactivation in the isolation of pox virus hybrids," *J. Hyg Camb* 62(2): 133-140.

Fenner, F. (Aug. 1959). "Genetic studies with mammalian poxviruses. II. Recombination between two strains of vaccinia virus in single HeLa cells," *Virology* 8:499-507.

Hansen, H. (2004). "Recombinant viruses obtained from co-infection in vitro with a live vaccinia-vectored influenza vaccine and a naturally occurring cowpox virus display different plaque phenotypes and loss of the transgene," Vaccine 23(4):499-506.

Ichahashi, et al. (1969). "Genetic study of poxgroup viruses," *Uirisu* 19(4):155-163.

Kirn, D.H. et al. (Apr. 1, 2008). "Enhancing poxvirus oncolytic effects through increased spread and immune evasion," *Cancer Res* 68(7):2071-2075.

Sutter, G. et al. (Nov. 15, 1992). "Nonreplicating vaccinia vector efficiently expresses recombinant genes," *PNAS USA* 89(22):10847-10851.

Third Party Observations against EP17840232, mailed on Aug. 28, 2023, 16 pages.

Vaccinia virus—VR-1566, located at <https://www.atcc.org/products/vr-1566> last visited Aug. 24, 2023, 10 pages.

Volume of un-injected tumors

Positive control

#33-(H5)Emerald

CHIMERIC POXVIRUS COMPOSITIONS AND USES THEREOF

CROSS-REFERENCES TO RELATED APPLICATIONS

This application is a U.S. National Phase Application of PCT Application No. PCT/US2017/046163, which claims priority to U.S. Provisional Application No. 62/372,408, filed Aug. 9, 2016 and U.S. Provisional Application No. 62/519,010, filed Jun. 13, 2017, which are hereby incorporated by reference in their entirety and for all purposes.

REFERENCE TO A "SEQUENCE LISTING," A TABLE, OR A COMPUTER PROGRAM LISTING APPENDIX SUBMITTED AS AN ASCII FILE

The Sequence Listing written in file 048440-606N01US_ST25, created on Mar. 13, 2023, 696,324 bytes, machine format IBM-PC, MS-Windows operating system, is hereby incorporated by reference.

BACKGROUND OF THE INVENTION

Cancer is the second leading cause of death in the United States. In recent years, great progress has been made in cancer immunotherapy, including immune checkpoint inhibitors, T cells with chimeric antigen receptors, and oncolytic viruses. Oncolytic viruses are naturally occurring or genetically modified viruses that infect, replicate in, and eventually kill cancer cells while leaving healthy cells unharmed. The clinical benefits of oncolytic viruses as stand-alone treatments, however, remain limited. New compositions taking advantage of the beneficial features of oncolytic viruses, while maximizing safety and clinical outcomes, are needed in the art. Disclosed herein, inter alia, are solutions to these and other problems in the art.

BRIEF SUMMARY OF THE INVENTION

In an aspect, is provided a chimeric poxvirus including a nucleic acid sequence having a sequence identity of at least 70% to SEQ ID NO:1 or SEQ ID NO:2, wherein the nucleic acid sequence includes nucleic acid fragments from at least two poxvirus strains selected from the group including cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS.

In an aspect, provided is an isolated nucleic acid encoding a chimeric poxvirus as described herein.

In an aspect is provided a pharmaceutical composition including a therapeutically effective amount of a chimeric poxvirus as described herein.

In an another aspect is provided a method of treating cancer in a subject in need thereof, the method including administering to the subject a therapeutically effective amount of a chimeric poxvirus as described herein, thereby treating cancer in the subject. In embodiments, the cancer is breast cancer, colon cancer, kidney cancer, leukemia, lung cancer, melanoma, ovarian cancer, prostate cancer, pancreatic cancer, brain cancer, liver cancer, gastric cancer or a sarcoma.

In another aspect is provided a method of forming a chimeric poxvirus, the method including: infecting a cell with at least two poxvirus strains selected from the group including cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS; and allowing the at least two poxvirus strains to replicate, thereby forming the chimeric poxvirus.

In an aspect is provided a method of inhibiting cell proliferation of a cell, the method including contacting a cell with a chimeric poxvirus as described herein.

In an aspect is provided a chimeric poxvirus including a nucleic acid sequence having a sequence identity of at least 70% to SEQ ID NO:1 or SEQ ID NO:2, wherein the nucleic acid sequence includes: (i) nucleic acid fragments from at least two poxvirus strains selected from the group consisting of cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS; (ii) one or more anti-cancer nucleic acid sequences; or (iii) a detectable moiety-encoding nucleic acid sequence.

In another aspect is provided a chimeric poxvirus including a nucleic acid sequence having a sequence identity of at least 70% to SEQ ID NO:1, wherein the nucleic acid sequence includes: (i) nucleic acid fragments from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, and vaccinia virus strain AS; (ii) one or more anti-cancer nucleic acid sequences; or (iii) a detectable moiety-encoding nucleic acid sequence.

In another aspect is provided a chimeric poxvirus including a nucleic acid sequence having a sequence identity of at least 70% to SEQ ID NO:2, wherein the nucleic acid sequence includes: (i) nucleic acid fragments from orf virus strain NZ2 and pseudocowpox virus strain TJS; (ii) one or more anti-cancer nucleic acid sequences; or (iii) a detectable moiety-encoding nucleic acid sequence.

In another aspect is provided a chimeric poxvirus including a nucleic acid sequence having a sequence identity of at least 70% to SEQ ID NO:3, wherein the nucleic acid sequence includes: (i) nucleic acid fragments from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, and vaccinia virus strain AS; (ii) one or more anti-cancer nucleic acid sequences; or (iii) a detectable moiety-encoding nucleic acid sequence.

In an aspect is provided a chimeric poxvirus including a nucleic acid sequence having a sequence identity of at least 70% to SEQ ID NO:1 or SEQ ID NO:2, wherein the nucleic acid sequence includes: (i) nucleic acid fragments from at least two poxvirus strains selected from the group consisting of cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS; (ii) one or more anti-cancer nucleic acid sequences; (iii) one or more nucleic acid binding sequences; or (iv) a detectable moiety-encoding nucleic acid sequence.

In another aspect is provided a chimeric poxvirus including a nucleic acid sequence having a sequence identity of at least 70% to SEQ ID NO:1, wherein the nucleic acid sequence includes: (i) nucleic acid fragments from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, and vaccinia virus strain AS; (ii) one or more anti-cancer nucleic acid sequences; (iii) one or more nucleic acid binding sequences; or (iv) a detectable moiety-encoding nucleic acid sequence.

In another aspect is provided a chimeric poxvirus including a nucleic acid sequence having a sequence identity of at least 70% to SEQ ID NO:2, wherein the nucleic acid sequence includes: (i) nucleic acid fragments from orf virus strain NZ2 and pseudocowpox virus strain TJS; (ii) one or more anti-cancer nucleic acid sequences; (iii) one or more nucleic acid binding sequences; or (iv) a detectable moiety-encoding nucleic acid sequence.

In another aspect is provided a chimeric poxvirus including a nucleic acid sequence having a sequence identity of at least 70% to SEQ ID NO:3, wherein the nucleic acid sequence includes: (i) nucleic acid fragments from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, and vaccinia virus strain AS; (ii) one or more anti-cancer nucleic acid sequences; (iii) one or more nucleic acid binding sequences; or (iv) a detectable moiety-encoding nucleic acid sequence.

BRIEF DESCRIPTION OF THE DRAWINGS

(FIG. 6A) Hs578T. LD50, MOI 0.396 (SD 0.113), (FIG. 6B) BT549. LD50, MOI 1.636 (SD 0.539), (FIG. 6C) MDA-MB-468. LD50, MOI 0.185 (SD 0.071), (FIG. 6D) MDA-MB-231. LD50, MOI 1.712 (SD 1.263). LD50 (at 96 hrs), median lethal dose; MOI, multiplicity of infection; SD, standard deviation.

(FIG. 10A) Control tumor, 10×, (FIG. 10B) Tumor from $10^5$ PFU treatment group, 10×, (FIG. 10C) Tumor from $10^5$ PFU treatment group, 60×. (ORF and DAPI counterstain).

FIG. 19A shows percent cell survival over time for LoVo cancer cells treated with #33 at a MOI of 1, 0.1, or 0.01. FIG. 19B shows a bar graph comparing percent cell survival at 120 hours for LoVo cancer cells treated with virus as indicated. Statistical analysis was performed comparing #33 to other experimental groups using One-Way ANOVA at each time point. "NS" above comparison bar means "not significant.

FIG. 24 shows HT-29 tumor percent change over time. A significant difference in tumor volume percent change was noted when comparing PBS control to both #33 (3 mice) and #33-(H5)Fluc2 (p=0.02 and p=0.03, respectively).

FIG. 25 shows HCT-116 tumor percent change over time. A significant difference in tumor volume percent change was noted when comparing PBS control to #33 (3 mice), #33-(SE)hNIS and #33-(H5) Fluc2 (p=0.0002, p=0.0001 and p=0.0002, respectively).

In FIGS. 34A-34B, each line represents the average tumor volume in an individual treatment group with the standard deviation. Statistical analysis: one-way ANOVA at day 24 (*=$p<0.05$).

FIG. 35A shows PFU/g of tumor for each virus in the injected tumor. FIG. 35B shows PFU/g of tumor for each virus in the un-injected tumor.

FIG. 36 shows PFU/g of tissue (ovaries) for each virus. Not detected (ND).

FIG. 37 shows PFU/mL of blood for each virus injected. Not detected (ND).

FIG. 45A. MOI of the viruses required to kill 50% of A549 cells (LD50) was calculated for all the viruses and compared. FIG. 45B. Cells were infected with #33 or parental viruses at an MOI 0.03 pfu and fold increase in the virus titer relative to input virus was determined 24 hour post-infection and compared among the viruses. FIG. 45C. A549 cells were infected with the viruses as in FIG. 45B and supernatant from the infected wells was collected at 12 h and 18 h post-infection. Virus titer in the supernatant was determined by plaque assay and compared among the viruses.

FIG. 46A. 5000 cells were plated in each well of a 96-well plate. Next day, cells were infected with the chimeric virus #33 or #33-(H5)Emerald that has the J2R (TK) gene replaced with Emerald (green) expression cassette, at different MOIs. Cell viability was determined using CELLTITER 96™ AQueous One Solution (Promega; Cat #G3581), 72 hours post-infection. Survival of infected cells was calculated relative to that of mock-infected cells. FIG. 46B. A549 cells were infected with #33 or #33-(H5) at an MOI 0.03 pfu and fold increase in the virus titer relative to input virus was determined at indicated time points.

FIG. 47A. Imaging: A549, human lung cancer cells, were cultured, trysinized, washed with PBS and resuspended in 1:1 PBS and matrigel to get a $5\times10^6$ cells per 100 μL. 100 μL of the cell suspension was injected sub-cutaneously on each side of upper flank of athymic nude mice to generate 2 tumors per mouse. 3 weeks post-tumor cell injections, the mice were sorted into different treatment groups (n=5) so as to obtain similar average tumor volume in each group (~200 $mm^3$). After sorting, only the right-side tumor in each mouse was injected with $10^3$ plaque forming units (PFUs) of #33-(H5)Emerald or PBS intra-tumorally. Mice were imaged for green fluorescence (excitation: 465 & emission: 530 nm) twice weekly using small animal imaging equipment (LagoX imaging system) and images were processed using the AMIview image processing software. FIG. 47B. Mean fluorescence intensity (MFI) of the Emerald was calculated for each tumor at different time points using the AMIview image processing software. The average MFI (n=5 mice/group) for the injected and non-injected tumors was compared.

FIG. 48A. A549, human lung cancer cells, were cultured, trysinized, washed with PBS and resuspended in 1:1 PBS and matrigel to get a $5\times10^6$ cells per 100 μL. 100 μL of the cell suspension was injected sub-cutaneously on each side of upper flank of athymic nude mice to generate 2 tumors per mouse. 3 weeks post-tumor cell injections, the mice were sorted into different treatment groups (n=7) so as to obtain similar average tumor volume in each group (~200 $mm^3$). After sorting, only the right-side tumor in each mouse was injected $10^3$ PFUs #33-(H5) Emerald PBS intra-tumorally. Mice were weighed twice weekly and percent change in their weight was plotted. Each line represents weight of individual mouse. FIG. 48B. Volume of tumors was measured twice weekly using digital calipers (volume={(length)$^2$×breadth/2}. Each line represents average volume of injected tumors in individual treatment group with the SD. Stats: unpaired T-test; **=p<0.0001. 33-GFP refers to animals treated with #33-(H5)Emerald. FIG. 48C. Tumor volume for individual mice in each treatment group has been plotted. FIG. 48D. Mice were euthanised when either of the bilateral tumors exceeded tumor burden (3000 $mm^3$) and survival curve for the virus treated group was compared with that of the PBS treated group. Stats: Log-rank (Mantel Cox) test; ****=p<0.0001.

FIG. 49A. A549, human lung cancer cells, were cultured, trysinized, washed with PBS and resuspended in 1:1 PBS and matrigel to get a $5\times10^6$ cells per 100 μL. 100 μL of the cell suspension was injected sub-cutaneously on each side of upper flank of athymic nude mice to generate 2 tumors per mouse. 3 weeks post-tumor cell injections, the mice were sorted into different treatment groups (n=4 or 5) so as to obtain similar average tumor volume in each group (~200 $mm^3$). After sorting, only the right-side tumor in each mouse was injected $10^3$ PFUs of the indicated viruses, intra-tumorally. At day 7 and 56 after virus injection, 3 mice from the virus treated group were euthanised and their organs as well as tumors were harvested. Virus titers in the harvested organs were determined by plaque assay and compared among the tumors and organs. Stats: One way ANOVA; *=p<0.0001. ND=not detectable. FIG. 49B. Tumor sections (7 days after virus injection) were stained for vaccinia virus. Dark staining represents virus infected regions of tumor sections. Each section is from a separate mouse. FIG. 49**C. Tumor sections obtained at day 7 after virus injection were stained for apoptotic cells using In Situ Cell death detection Fluorescein (Roche). For 'positive control,' tumor sections were treated with recombinant Dnase I (300 U/ml) for 10 minutes at room temperature. Gray signal represents apoptotic cells.

FIGS. 54A and 54B show average tumor volume for injected and un-injected tumors, respectively.

DETAILED DESCRIPTION OF THE INVENTION

Figure 1:
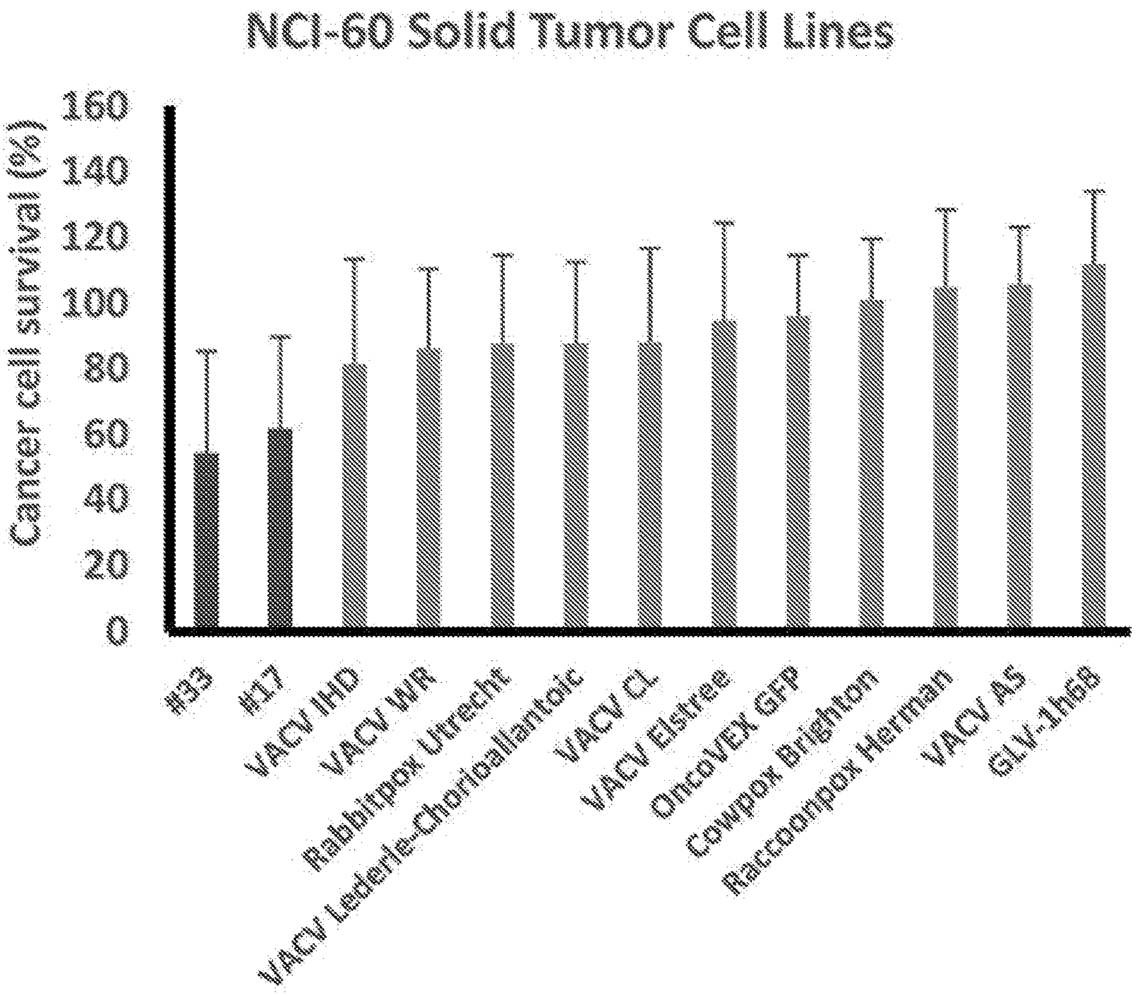
FIG. 1. Novel chimeric orthopoxvirus isolates #33 (SEQ ID NO:1) and #17 (SEQ ID NO:3) show superior cancer cell killing capability compared to the parental individual wild-type virus strains and the control viruses GLV-1h68 and OncoVEX GFP.

Described herein are chimeric poxvirus compositions which combine favorable features from different virus species to create novel hybrid chimeric poxviruses, which are superior to individual wild-type viruses. Applicants have generated chimeric poxviruses from different genera. Chimeric orthopoxvirus and parapoxvirus isolates showed superior killing capacity in a panel of the NCI 60 cancer cell lines compared to their parental individual wild-type viruses. Additionally, taking advantage of the fact that members from different genera of the poxviridae family are antigenically distinct the potent chimeric orthopoxvirus and the potent chimeric parapoxvirus generated in this study can be potentially combined into the same treatment regimen to achieve the maximum therapeutic efficacy.

I. Definitions

While various embodiments and aspects of the present invention are shown and described herein, it will be obvious to those skilled in the art that such embodiments and aspects are provided by way of example only. Numerous variations, changes, and substitutions will now occur to those skilled in the art without departing from the invention. It should be understood that various alternatives to the embodiments of the invention described herein may be employed in practicing the invention.

The section headings used herein are for organizational purposes only and are not to be construed as limiting the subject matter described. All documents, or portions of documents, cited in the application including, without limitation, patents, patent applications, articles, books, manuals, and treatises are hereby expressly incorporated by reference in their entirety for any purpose.

Unless defined otherwise, technical and scientific terms used herein have the same meaning as commonly understood by a person of ordinary skill in the art. See, e.g., Singleton et al., DICTIONARY OF MICROBIOLOGY AND MOLECULAR BIOLOGY 2nd ed., J. Wiley & Sons (New York, NY 1994); Sambrook et al., MOLECULAR CLONING, A LABORATORY MANUAL, Cold Springs Harbor Press (Cold Springs Harbor, N Y 1989). Any methods, devices and materials similar or equivalent to those described herein can be used in the practice of this invention. The following definitions are provided to facilitate understanding of certain terms used frequently herein and are not meant to limit the scope of the present disclosure.

The terms "isolate" or "isolated", when applied to a nucleic acid, virus, or protein, denotes that the nucleic acid, virus, or protein is essentially free of other cellular components with which it is associated in the natural state. It can be, for example, in a homogeneous state and may be in either a dry or aqueous solution. Purity and homogeneity are typically determined using analytical chemistry techniques such as polyacrylamide gel electrophoresis or high performance liquid chromatography. A protein that is the predominant species present in a preparation is substantially purified.

"Nucleic acid" or "oligonucleotide" or "polynucleotide" or grammatical equivalents used herein means at least two nucleotides covalently linked together. The term "Nucleic acid" refers to deoxyribonucleotides or ribonucleotides and polymers thereof in either single- or double-stranded form, or complements thereof. The term "polynucleotide" refers to a linear sequence of nucleotides. The term "nucleotide" typically refers to a single unit of a polynucleotide, i.e., a monomer. Nucleotides can be ribonucleotides, deoxyribonucleotides, or modified versions thereof. Examples of polynucleotides contemplated herein include single and double stranded DNA, single and double stranded RNA (including siRNA), and hybrid molecules having mixtures of single and double stranded DNA and RNA. The terms also encompass nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, and 2-O-methyl ribonucleotides.

Nucleic acids may include nonspecific sequences. As used herein, the term "nonspecific sequence" refers to a nucleic acid sequence that contains a series of residues that are not designed to be complementary to or are only partially complementary to any other nucleic acid sequence. By way of example, a nonspecific nucleic acid sequence is a sequence of nucleic acid residues that does not function as an inhibitory nucleic acid when contacted with a cell or organism. An "inhibitory nucleic acid" is a nucleic acid (e.g. DNA, RNA, polymer of nucleotide analogs) that is capable of binding to a target nucleic acid (e.g. an mRNA translatable into a protein) and reducing transcription of the target nucleic acid (e.g. mRNA from DNA) or reducing the translation of the target nucleic acid (e.g. mRNA) or altering transcript splicing (e.g. single stranded morpholino oligo).

A "labeled nucleic acid or oligonucleotide" is one that is bound, either covalently, through a linker or a chemical bond, or noncovalently, through ionic, van der Waals, electrostatic, or hydrogen bonds to a label such that the presence of the nucleic acid may be detected by detecting the presence of the detectable label bound to the nucleic acid. Alternatively, a method using high affinity interactions may achieve the same results where one of a pair of binding partners binds to the other, e.g., biotin, streptavidin. In embodiments, the phosphorothioate nucleic acid or phosphorothioate polymer backbone includes a detectable label, as disclosed herein and generally known in the art.

The words "complementary" or "complementarity" refer to the ability of a nucleic acid in a polynucleotide to form a base pair with another nucleic acid in a second polynucleotide. For example, the sequence A-G-T is complementary to the sequence T-C-A. Complementarity may be partial, in which only some of the nucleic acids match according to base pairing, or complete, where all the nucleic acids match according to base pairing.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are near each other, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

The term "gene" means the segment of DNA involved in producing a protein; it includes regions preceding and following the coding region (leader and trailer) as well as intervening sequences (introns) between individual coding segments (exons). The leader, the trailer as well as the introns include regulatory elements that are necessary during the transcription and the translation of a gene. Further, a "protein gene product" is a protein expressed from a particular gene.

The word "expression" or "expressed" as used herein in reference to a gene means the transcriptional and/or translational product of that gene. The level of expression of a DNA molecule in a cell may be determined on the basis of either the amount of corresponding mRNA that is present within the cell or the amount of protein encoded by that DNA produced by the cell. The level of expression of non-coding nucleic acid molecules (e.g., siRNA) may be detected by standard PCR or Northern blot methods well known in the art. See, Sambrook et al., 1989 *Molecular Cloning: A Laboratory Manual,* 18.1-18.88.

A "siRNA," "small interfering RNA," "small RNA," or "RNAi" as provided herein refers to a nucleic acid that forms a double stranded RNA, which double stranded RNA has the ability to reduce or inhibit expression of a gene or target gene when expressed in the same cell as the gene or target gene. The complementary portions of the nucleic acid that hybridize to form the double stranded molecule typically have substantial or complete identity. In one embodiment, a siRNA or RNAi refers to a nucleic acid that has substantial or complete identity to a target gene and forms a double stranded siRNA. In embodiments, the siRNA inhibits gene expression by interacting with a complementary cellular mRNA thereby interfering with the expression of the complementary mRNA. Typically, the nucleic acid is at least about 15-50 nucleotides in length (e.g., each complementary sequence of the double stranded siRNA is 15-50 nucleotides in length, and the double stranded siRNA is about 15-50 base pairs in length). In other embodiments, the length is 20-30 base nucleotides, preferably about 20-25 or about 24-29 nucleotides in length, e.g., 20, 21, 22, 23, 24, 25, 26, 27, 28, 29, or 30 nucleotides in length. Non-limiting examples of siRNAs include ribozymes, RNA decoys, short hairpin RNAs (shRNA), micro RNAs (miRNA) and small nucleolar RNAs (snoRNA).

The term "recombinant" when used with reference, e.g., to a cell, or nucleic acid, protein, or vector, indicates that the cell, nucleic acid, protein or vector, has been modified by the introduction of a heterologous nucleic acid or protein or the alteration of a native nucleic acid or protein, or that the cell is derived from a cell so modified. Thus, for example, recombinant cells express genes that are not found within the native (non-recombinant) form of the cell or express native genes that are otherwise abnormally expressed, under expressed or not expressed at all. Transgenic cells and plants are those that express a heterologous gene or coding sequence, typically as a result of recombinant methods.

The term "heterologous" when used with reference to portions of a nucleic acid indicates that the nucleic acid comprises two or more subsequences that are not found in the same relationship to each other in nature. For instance, the nucleic acid is typically recombinantly produced, having two or more sequences from unrelated genes arranged to make a new functional nucleic acid, e.g., a promoter from one source and a coding region from another source. Similarly, a heterologous protein indicates that the protein comprises two or more subsequences that are not found in the same relationship to each other in nature (e.g., a fusion protein).

The term "exogenous" refers to a molecule or substance (e.g., a compound, nucleic acid or protein) that originates from outside a given cell or organism. For example, an "exogenous promoter" as referred to herein is a promoter that does not originate from the cell or organism it is expressed by. Conversely, the term "endogenous" or "endogenous promoter" refers to a molecule or substance that is native to, or originates within, a given cell or organism.

The term "isolated", when applied to a nucleic acid or protein, denotes that the nucleic acid or protein is essentially free of other cellular components with which it is associated in the natural state. It can be, for example, in a homogeneous state and may be in either a dry or aqueous solution. Purity and homogeneity are typically determined using analytical chemistry techniques such as polyacrylamide gel electrophoresis or high performance liquid chromatography. A protein that is the predominant species present in a preparation is substantially purified.

The terms "polypeptide," "peptide" and "protein" are used interchangeably herein to refer to a polymer of amino acid residues, wherein the polymer may In embodiments be conjugated to a moiety that does not consist of amino acids. The terms apply to amino acid polymers in which one or more amino acid residue is an artificial chemical mimetic of a corresponding naturally occurring amino acid, as well as to naturally occurring amino acid polymers and non-naturally occurring amino acid polymers. A "fusion protein" refers to a chimeric protein encoding two or more separate protein sequences that are recombinantly expressed as a single moiety.

The term "peptidyl" and "peptidyl moiety" means a monovalent peptide.

The term "amino acid" refers to naturally occurring and synthetic amino acids, as well as amino acid analogs and amino acid mimetics that function in a manner similar to the naturally occurring amino acids. Naturally occurring amino acids are those encoded by the genetic code, as well as those amino acids that are later modified, e.g., hydroxyproline, γ-carboxyglutamate, and O-phosphoserine. Amino acid analogs refers to compounds that have the same basic chemical structure as a naturally occurring amino acid, i.e., an a carbon that is bound to a hydrogen, a carboxyl group, an amino group, and an R group, e.g., homoserine, norleucine, methionine sulfoxide, methionine methyl sulfonium. Such analogs have modified R groups (e.g., norleucine) or modified peptide backbones, but retain the same basic chemical structure as a naturally occurring amino acid. Amino acid mimetics refers to chemical compounds that have a structure that is different from the general chemical structure of an amino acid, but that functions in a manner similar to a naturally occurring amino acid. The terms "non-naturally occurring amino acid" and "unnatural amino acid" refer to amino acid analogs, synthetic amino acids, and amino acid mimetics which are not found in nature.

Amino acids may be referred to herein by either their commonly known three letter symbols or by the one-letter symbols recommended by the IUPAC-IUB Biochemical Nomenclature Commission. Nucleotides, likewise, may be referred to by their commonly accepted single-letter codes.

"Conservatively modified variants" applies to both amino acid and nucleic acid sequences. With respect to particular nucleic acid sequences, "conservatively modified variants" refers to those nucleic acids that encode identical or essentially identical amino acid sequences. Because of the degeneracy of the genetic code, a number of nucleic acid sequences will encode any given protein. For instance, the codons GCA, GCC, GCG and GCU all encode the amino acid alanine. Thus, at every position where an alanine is specified by a codon, the codon can be altered to any of the corresponding codons described without altering the encoded polypeptide.

Such nucleic acid variations are "silent variations," which are one species of conservatively modified variations. Every nucleic acid sequence herein which encodes a polypeptide also describes every possible silent variation of the nucleic acid. One of skill will recognize that each codon in a nucleic acid (except AUG, which is ordinarily the only codon for methionine, and TGG, which is ordinarily the only codon for tryptophan) can be modified to yield a functionally identical molecule. Accordingly, each silent variation of a nucleic acid which encodes a polypeptide is implicit in each described sequence.

As to amino acid sequences, one of skill will recognize that individual substitutions, deletions or additions to a nucleic acid, peptide, polypeptide, or protein sequence which alters, adds or deletes a single amino acid or a small percentage of amino acids in the encoded sequence is a "conservatively modified variant" where the alteration results in the substitution of an amino acid with a chemically similar amino acid. Conservative substitution tables providing functionally similar amino acids are well known in the art. Such conservatively modified variants are in addition to and do not exclude polymorphic variants, interspecies homologs, and alleles of the invention.

The following eight groups each contain amino acids that are conservative substitutions for one another: 1) Alanine (A), Glycine (G); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); 6) Phenylalanine (F), Tyrosine (Y), Tryptophan (W); 7) Serine (S), Threonine (T); and 8) Cysteine (C), Methionine (M) (see, e.g., Creighton, Proteins (1984)).

The terms "identical" or percent "identity," in the context of two or more nucleic acids or polypeptide sequences, refer to two or more sequences or subsequences that are the same or have a specified percentage of amino acid residues or nucleotides that are the same (i.e., about 60% identity, preferably 65%, 70%, 75%, 80%, 85%, 90%, 91%, 92%, 93%, 94%, 95%, 96%, 97%, 98%, 99%, or higher identity over a specified region, when compared and aligned for maximum correspondence over a comparison window or designated region) as measured using a BLAST or BLAST 2.0 sequence comparison algorithms with default parameters described below, or by manual alignment and visual inspection (see, e.g., NCBI web site http://www.ncbi.nlm.nih.gov/BLAST/ or the like). Such sequences are then said to be "substantially identical." This definition also refers to, or may be applied to, the compliment of a test sequence. The definition also includes sequences that have deletions and/or additions, as well as those that have substitutions. As described below, the preferred algorithms can account for gaps and the like. Preferably, identity exists over a region that is at least about 25 amino acids or nucleotides in length, or more preferably over a region that is 50-100 amino acids or nucleotides in length.

The terms "thymidine kinase gene", "TK gene", "TK", "J2R gene", or "J2R" as used herein refer to the any of the recombinant or naturally-occurring forms of the thymidine kinase gene or variants or homologs thereof that code for a thymidine kinase polypeptide capable of maintaining the activity of the thymidine kinase polypeptide (e.g., within at least 50%, 80%, 90%, 95%, 96%, 97%, 98%, 99% or 100% activity compared to thymidine kinase polypeptide). In some aspects, the variants or homologs have at least 90%, 95%, 96%, 97%, 98%, 99% or 100% nucleic acid sequence identity across the whole sequence or a portion of the sequence (e.g., a 50, 100, 150 or 200 continuous nucleic acid portion) compared to a naturally occurring thymidine kinase gene. In embodiments, the thymidine kinase gene is substantially identical to the nucleic acid sequence corresponding to position 83422-83955 of the nucleic acid sequence identified by Accession No. DQ121394 or a variant or homolog having substantial identity thereto. In embodiments, the thymidine kinase gene includes the nucleic acid sequence of SEQ ID NO:4. In embodiments, the thymidine kinase gene is the nucleic acid sequence of SEQ ID NO:4. In embodiments, the thymidine kinase gene is mutated. In embodiments, the thymidine kinase gene is partially deleted. In embodiments, the thymidine kinase gene includes the nucleic acid sequence of SEQ ID NO:5. In embodiments, the thymidine kinase gene includes the nucleic acid sequence of SEQ ID NO:5.

The term "F14.5L gene", "F14.5L sequence", "F14.5L", or the like, as used herein refers to the any of the recombinant or naturally-occurring forms of the F14.5L gene or variants or homologs thereof that code for a F14.5L polypeptide capable of maintaining the activity of the F14.5L polypeptide (e.g., within at least 50%, 80%, 90%, 95%, 96%, 97%, 98%, 99% or 100% activity compared to F14.5L polypeptide). In some aspects, the variants or homologs have at least 90%, 95%, 96%, 97%, 98%, 99% or 100% nucleic acid sequence identity across the whole sequence or a portion of the sequence (e.g., a 50, 100, 150 or 200 continuous nucleic acid portion) compared to a naturally occurring F14.5L gene. In embodiments, the F14.5L gene is substantially identical to the nucleic acid sequence corresponding to position 44428-44279 of the nucleic acid sequence identified by Accession No. KX781953 or a variant or homolog having substantial identity thereto. In embodiments, the F14.5L gene includes the nucleic acid sequence of SEQ ID NO:6. In embodiments, the F14.5L gene is the nucleic acid sequence of SEQ ID NO:6. In embodiments, the F14.5L gene is mutated. In embodiments, the F14.5L gene is partially deleted. In embodiments, the F14.5L gene includes the nucleic acid sequence of SEQ ID NO:7. In embodiments, the F14.5L gene includes the nucleic acid sequence of SEQ ID NO:7.

The terms "D4R gene", "uracil DNA glycosylase gene", or the like, as used herein refer to the any of the recombinant or naturally-occurring forms of the uracil DNA glycosylase gene or variants or homologs thereof that code for a uracil DNA glycosylase polypeptide capable of maintaining the activity of the uracil DNA glycosylase polypeptide (e.g., within at least 50%, 80%, 90%, 95%, 96%, 97%, 98%, 99% or 100% activity compared to uracil DNA glycosylase polypeptide). In some aspects, the variants or homologs have at least 90%, 95%, 96%, 97%, 98%, 99% or 100% nucleic acid sequence identity across the whole sequence or a portion of the sequence (e.g., a 50, 100, 150 or 200 continuous nucleic acid portion) compared to a naturally occurring uracil DNA glycosylase gene. In embodiments, the uracil DNA glycosylase gene is substantially identical to the nucleic acid sequence corresponding to position 102720-103376 of the nucleic acid sequence identified by Accession No. DQ439815 or a variant or homolog having substantial identity thereto. In embodiments, the uracil DNA glycosylase gene includes the nucleic acid sequence of SEQ ID NO:8. In embodiments, the uracil DNA glycosylase gene is the nucleic acid sequence of SEQ ID NO:8.

The terms "E9L gene", "DNA polymerase gene", or the like, as used herein refer to the any of the recombinant or naturally-occurring forms of the DNA polymerase gene or variants or homologs thereof that code for a DNA polymerase polypeptide capable of maintaining the activity of the DNA polymerase polypeptide (e.g., within at least 50%, 80%, 90%, 95%, 96%, 97%, 98%, 99% or 100% activity compared to DNA polymerase polypeptide). In some aspects, the variants or homologs have at least 90%, 95%, 96%, 97%, 98%, 99% or 100% nucleic acid sequence identity across the whole sequence or a portion of the sequence (e.g., a 50, 100, 150 or 200 continuous nucleic acid portion) compared to a naturally occurring DNA polymerase gene. In embodiments, the DNA polymerase gene is substantially identical to the nucleic acid sequence corresponding to position 56656-53636 of the nucleic acid sequence identified by Accession No. AY243312 or a variant or homolog having substantial identity thereto. In embodiments, the DNA polymerase gene includes the nucleic acid sequence of SEQ ID NO:12. In embodiments, the DNA polymerase gene is the nucleic acid sequence of SEQ ID NO:12.

The terms "human sodium and iodide symporter gene", "hNIS gene", "NIS gene" or the like, as used herein refer to the any of the recombinant or naturally-occurring forms of the human sodium and iodide symporter gene or variants or homologs thereof that code for a human sodium and iodide symporter polypeptide capable of maintaining the activity of the human sodium and iodide symporter polypeptide (e.g., within at least 50%, 80%, 90%, 95%, 96%, 97%, 98%, 99% or 100% activity compared to human sodium and iodide symporter polypeptide). In some aspects, the variants or homologs have at least 90%, 95%, 96%, 97%, 98%, 99% or 100% nucleic acid sequence identity across the whole sequence or a portion of the sequence (e.g., a 50, 100, 150 or 200 continuous nucleic acid portion) compared to a naturally occurring human sodium and iodide symporter gene. In embodiments, the human sodium and iodide symporter gene is substantially identical to the nucleic acid sequence identified by Accession No. NM_000453 or a variant or homolog having substantial identity thereto. In embodiments, the human sodium and iodide symporter gene includes the nucleic acid sequence of SEQ ID NO:13. In embodiments, the human sodium and iodide symporter gene is the nucleic acid sequence of SEQ ID NO:13.

The terms "Emerald gene" or "Emerald sequence" as used herein refer to the genetically engineered gene or variants thereof that code for an Emerald polypeptide capable of maintaining the activity of the Emerald polypeptide (e.g., within at least 50%, 80%, 90%, 95%, 96%, 97%, 98%, 99% or 100% activity compared to the Emerald polypeptide). In some aspects, the variants or homologs have at least 90%, 95%, 96%, 97%, 98%, 99% or 100% nucleic acid sequence identity across the whole sequence or a portion of the sequence (e.g., a 50, 100, 150 or 200 continuous nucleic acid portion) compared to the Emerald sequence. In embodiments, Emerald is substantially identical to the nucleic acid sequence corresponding to position 3215-3931 of the nucleic acid sequence identified by Accession No. KF293661 or a variant or homolog having substantial identity thereto. In embodiments, the Emerald gene includes the nucleic acid sequence of SEQ ID NO:14. In embodiments, the Emerald gene is the nucleic acid sequence of SEQ ID NO:14.

The terms "firefly luciferase gene" or "firefly luciferase sequence", as used herein refer to the any of the recombinant or naturally-occurring forms of the firefly luciferase gene or variants or homologs thereof that code for a firefly luciferase polypeptide capable of maintaining the activity of the firefly luciferase polypeptide (e.g., within at least 50%, 80%, 90%, 95%, 96%, 97%, 98%, 99% or 100% activity compared to firefly luciferase polypeptide). In some aspects, the variants or homologs have at least 90%, 95%, 96%, 97%, 98%, 99% or 100% nucleic acid sequence identity across the whole sequence or a portion of the sequence (e.g., a 50, 100, 150 or 200 continuous nucleic acid portion) compared to a naturally occurring firefly luciferase gene. In embodiments, the firefly luciferase gene is substantially identical to the nucleic acid sequence corresponding to position 3129-4781 of the nucleic acid sequence identified by Accession No. KF990214 or a variant or homolog having substantial identity thereto. In embodiments, the firefly luciferase gene includes the nucleic acid sequence of SEQ ID NO:15. In embodiments, the firefly luciferase gene is the nucleic acid sequence of SEQ ID NO:15.

The terms "mCherry gene" or "mCherry sequence" as used herein refer to the any of the recombinant or naturally-occurring forms of the gene or variants or homologs thereof that code for a mCherry polypeptide capable of maintaining the activity of the mCherry polypeptide (e.g., within at least 50%, 80%, 90%, 95%, 96%, 97%, 98%, 99% or 100% activity compared to mCherry polypeptide). In some aspects, the variants or homologs have at least 90%, 95%, 96%, 97%, 98%, 99% or 100% nucleic acid sequence identity across the whole sequence or a portion of the sequence (e.g., a 50, 100, 150 or 200 continuous nucleic acid portion) compared to a naturally occurring mCherry gene. In embodiments, the mCherry gene is substantially identical to the nucleic acid sequence corresponding to position 1073-1783 of the nucleic acid sequence identified by Accession No. KX446949 or a variant or homolog having substantial identity thereto. In embodiments, the mCherry gene includes the nucleic acid sequence of SEQ ID NO:16. In embodiments, the mCherry gene is the nucleic acid sequence of SEQ ID NO:16.

The terms "H5 promoter", "H5", or the like, as used herein refer to the any of the recombinant or naturally-occurring forms of the H5 promoter or variants or homologs thereof that maintain the activity of the H5 promoter (e.g., within at least 50%, 80%, 90%, 95%, 96%, 97%, 98%, 99% or 100% activity compared to the H5 promoter). In some aspects, the variants or homologs have at least 90%, 95%, 96%, 97%, 98%, 99% or 100% nucleic acid sequence identity across the whole sequence or a portion of the sequence (e.g., a 50, 100, 150 or 200 continuous nucleic acid portion) compared to a naturally occurring H5 promoter. In embodiments, the H5 promoter is substantially identical to the nucleic acid sequence corresponding to position 7-76 of the nucleic acid sequence identified by Accession No. FJ386852 or a variant or homolog having substantial identity thereto. In embodiments, the H5 promoter includes the nucleic acid sequence of SEQ ID NO:18. In embodiments, the H5 promoter is the nucleic acid sequence of SEQ ID NO:18.

The terms "SE promoter", "SE", or the like, as used herein refer to the any of the recombinant or naturally-occurring forms of the SE promoter or variants or homologs thereof that maintain the activity of the SE promoter (e.g., within at least 50%, 80%, 90%, 95%, 96%, 97%, 98%, 99% or 100% activity compared to the SE promoter). In some aspects, the variants or homologs have at least 90%, 95%, 96%, 97%, 98%, 99% or 100% nucleic acid sequence identity across the whole sequence or a portion of the sequence (e.g., a 50, 100, 150 or 200 continuous nucleic acid portion) compared to a naturally occurring SE promoter. In embodiments, the SE promoter includes the nucleic acid sequence of SEQ ID NO:19. In embodiments, the SE promoter is the nucleic acid sequence of SEQ ID NO:19.

The terms "11K promoter", "11K", or the like, as used herein refer to the any of the recombinant or naturally-occurring forms of the 11K promoter or variants or homologs thereof that maintain the activity of the 11K promoter (e.g., within at least 50%, 80%, 90%, 95%, 96%, 97%, 98%, 99% or 100% activity compared to the 11K promoter). In some aspects, the variants or homologs have at least 90%, 95%, 96%, 97%, 98%, 99% or 100% nucleic acid sequence identity across the whole sequence or a portion of the sequence (e.g., a 50, 100, 150 or 200 continuous nucleic acid portion) compared to a naturally occurring 11K promoter. In embodiments, the 11K promoter is substantially identical to the nucleic acid sequence corresponding to position 40734-40771 of the nucleic acid sequence identified by Accession No. KF179385 or a variant or homolog having substantial identity thereto. In embodiments, the 11K promoter includes the nucleic acid sequence of SEQ ID NO:20. In embodiments, the 11K promoter is the nucleic acid sequence of SEQ ID NO:20.

Antibodies are large, complex molecules (molecular weight of ~150,000 or about 1320 amino acids) with intricate internal structure. A natural antibody molecule contains two identical pairs of polypeptide chains, each pair having one light chain and one heavy chain. Each light chain and heavy chain in turn consists of two regions: a variable ("V") region involved in binding the target antigen, and a constant ("C") region that interacts with other components of the immune system. The light and heavy chain variable regions come together in 3-dimensional space to form a variable region that binds the antigen (for example, a receptor on the surface of a cell). Within each light or heavy chain variable region, there are three short segments (averaging 10 amino acids in length) called the complementarity determining regions ("CDRs"). The six CDRs in an antibody variable domain (three from the light chain and three from the heavy chain) fold up together in 3-dimensional space to form the actual antibody binding site which docks onto the target antigen. The position and length of the CDRs have been precisely defined by Kabat, E. et al., Sequences of Proteins of Immunological Interest, U.S. Department of Health and Human Services, 1983, 1987. The part of a variable region not contained in the CDRs is called the framework ("FR"), which forms the environment for the CDRs.

The term "antibody" is used according to its commonly known meaning in the art. Antibodies exist, e.g., as intact immunoglobulins or as a number of well-characterized fragments produced by digestion with various peptidases. Thus, for example, pepsin digests an antibody below the disulfide linkages in the hinge region to produce F(ab)'2, a dimer of Fab which itself is a light chain joined to $V_H$-$C_{H1}$ by a disulfide bond. The F(ab)'2 may be reduced under mild conditions to break the disulfide linkage in the hinge region, thereby converting the F(ab)'2 dimer into an Fab' monomer. The Fab' monomer is essentially Fab with part of the hinge region (see Fundamental Immunology (Paul ed., 3d ed. 1993). While various antibody fragments are defined in terms of the digestion of an intact antibody, one of skill will appreciate that such fragments may be synthesized de novo either chemically or by using recombinant DNA methodology. Thus, the term antibody, as used herein, also includes antibody fragments either produced by the modification of whole antibodies, or those synthesized de novo using recombinant DNA methodologies (e.g., single chain Fv) or those identified using phage display libraries (see, e.g., McCafferty et al., *Nature* 348:552-554 (1990)).

An exemplary immunoglobulin (antibody) structural unit comprises a tetramer. Each tetramer is composed of two identical pairs of polypeptide chains, each pair having one "light" (about 25 kD) and one "heavy" chain (about 50-70 kD). The N-terminus of each chain defines a variable region of about 100 to 110 or more amino acids primarily responsible for antigen recognition. The terms variable light chain (VL) and variable heavy chain (VH) refer to these light and heavy chains respectively. The Fc (i.e. fragment crystallizable region) is the "base" or "tail" of an immunoglobulin and is typically composed of two heavy chains that contribute two or three constant domains depending on the class of the antibody. By binding to specific proteins the Fc region ensures that each antibody generates an appropriate immune response for a given antigen. The Fc region also binds to various cell receptors, such as Fc receptors, and other immune molecules, such as complement proteins.

The term "antigen" as provided herein refers to molecules capable of binding to the antibody binding domain provided herein. An "antigen binding domain" as provided herein is a region of an antibody that binds to an antigen (epitope). As described above, the antigen binding domain is generally composed of one constant and one variable domain of each of the heavy and the light chain (VL, VH, CL and CH1, respectively). The paratope or antigen-binding site is formed on the N-terminus of the antigen binding domain. The two variable domains of an antigen binding domain typically bind the epitope on an antigen.

Antibodies exist, for example, as intact immunoglobulins or as a number of well-characterized fragments produced by digestion with various peptidases. Thus, for example, pepsin digests an antibody below the disulfide linkages in the hinge region to produce F(ab)'2, a dimer of Fab which itself is a light chain joined to VH-CH1 by a disulfide bond. The F(ab)'2 may be reduced under mild conditions to break the disulfide linkage in the hinge region, thereby converting the F(ab)'2 dimer into an Fab' monomer. The Fab' monomer is essentially the antigen binding portion with part of the hinge region (see Fundamental Immunology (Paul ed., 3d ed. 1993). While various antibody fragments are defined in terms of the digestion of an intact antibody, one of skill will appreciate that such fragments may be synthesized de novo either chemically or by using recombinant DNA methodology. Thus, the term antibody, as used herein, also includes antibody fragments either produced by the modification of whole antibodies, or those synthesized de novo using recombinant DNA methodologies (e.g., single chain Fv) or those identified using phage display libraries (see, e.g., McCafferty et al., Nature 348:552-554 (1990)).

A single-chain variable fragment (scFv) is typically a fusion protein of the variable regions of the heavy (VH) and light chains (VL) of immunoglobulins, connected with a short linker peptide of 10 to about 25 amino acids. The linker may usually be rich in glycine for flexibility, as well as serine or threonine for solubility. The linker can either connect the N-terminus of the VH with the C-terminus of the VL, or vice versa.

The epitope of an antibody is the region of its antigen to which the antibody binds. Two antibodies bind to the same or overlapping epitope if each competitively inhibits (blocks) binding of the other to the antigen. That is, a 1×, 5×, 10×, 20× or 100× excess of one antibody inhibits binding of the other by at least 30% but preferably 50%, 75%, 90% or even 99% as measured in a competitive binding assay (see, e.g., Junghans et al., Cancer Res. 50:1495, 1990). Alternatively, two antibodies have the same epitope if essentially all amino acid mutations in the antigen that reduce or eliminate binding of one antibody reduce or eliminate binding of the other. Two antibodies have overlapping epitopes if some amino acid mutations that reduce or eliminate binding of one antibody reduce or eliminate binding of the other.

For preparation of suitable antibodies of the invention and for use according to the invention, e.g., recombinant, monoclonal, or polyclonal antibodies, many techniques known in the art can be used (see, e.g., Kohler & Milstein, Nature 256:495-497 (1975); Kozbor et al., Immunology Today 4: 72 (1983); Cole et al., pp. 77-96 in Monoclonal Antibodies and Cancer Therapy, Alan R. Liss, Inc. (1985); Coligan, Current Protocols in Immunology (1991); Harlow & Lane, Antibodies, A Laboratory Manual (1988); and Goding, Monoclonal Antibodies: Principles and Practice (2d ed. 1986)). The genes encoding the heavy and light chains of an antibody of interest can be cloned from a cell, e.g., the genes encoding a monoclonal antibody can be cloned from a hybridoma and used to produce a recombinant monoclonal antibody. Gene libraries encoding heavy and light chains of monoclonal antibodies can also be made from hybridoma or plasma cells. Random combinations of the heavy and light chain gene products generate a large pool of antibodies with different antigenic specificity (see, e.g., Kuby, Immunology (3rd ed. 1997)). Techniques for the production of single chain antibodies or recombinant antibodies (U.S. Pat. Nos. 4,946,778, 4,816,567) can be adapted to produce antibodies to polypeptides of this invention. Also, transgenic mice, or other organisms such as other mammals, may be used to express humanized or human antibodies (see, e.g., U.S. Pat. Nos. 5,545,807; 5,545,806; 5,569,825; 5,625,126; 5,633,425; 5,661,016, Marks et al., Bio/Technology 10:779-783 (1992); Lonberg et al., Nature 368:856-859 (1994); Morrison, Nature 368:812-13 (1994); Fishwild et al., Nature Biotechnology 14:845-51 (1996); Neuberger, Nature Biotechnology 14:826 (1996); and Lonberg & Huszar, Intern. Rev. Immunol. 13:65-93 (1995)). Alternatively, phage display technology can be used to identify antibodies and heteromeric Fab fragments that specifically bind to selected antigens (see, e.g., McCafferty et al., Nature 348:552-554 (1990); Marks et al., Biotechnology 10:779-783 (1992)). Antibodies can also be made bispecific, i.e., able to recognize two different antigens (see, e.g., WO 93/08829, Traunecker et al., EMBO J. 10:3655-3659 (1991); and Suresh et al., Methods in Enzymology 121:210 (1986)). Antibodies can also be heteroconjugates, e.g., two covalently joined antibodies, or immunotoxins (see, e.g., U.S. Pat. No. 4,676,980, WO 91/00360; WO 92/200373; and EP 03089).

The phrase "specifically (or selectively) binds to an antibody" or "specifically (or selectively) immunoreactive with," when referring to a protein or peptide refers to a binding reaction that is determinative of the presence of the protein, often in a heterogeneous population of proteins and other biologics. Thus, under designated immunoassay conditions, the specified antibodies bind to a particular protein at least two times the background and more typically more than 10 to 100 times background. Specific binding to an antibody under such conditions typically requires an antibody that is selected for its specificity for a particular protein. For example, polyclonal antibodies can be selected to obtain only a subset of antibodies that are specifically immunoreactive with the selected antigen and not with other proteins. This selection may be achieved by subtracting out antibodies that cross-react with other molecules. A variety of immunoassay formats may be used to select antibodies specifically immunoreactive with a particular protein. For example, solid-phase ELISA immunoassays are routinely used to select antibodies specifically immunoreactive with a protein (see, e.g., Harlow & Lane, Using Antibodies, A Laboratory Manual (1998) for a description of immunoassay formats and conditions that can be used to determine specific immunoreactivity).

"Contacting" is used in accordance with its plain ordinary meaning and refers to the process of allowing at least two distinct species (e.g. chemical compounds including biomolecules or cells) to become sufficiently proximal to react, interact or physically touch. It should be appreciated; however, the resulting reaction product can be produced directly from a reaction between the added reagents or from an intermediate from one or more of the added reagents which can be produced in the reaction mixture.

The term "contacting" may include allowing two species to react, interact, or physically touch, wherein the two species may be, for example, an antibody domain as described herein and an antibody-binding domain. In embodiments contacting includes, for example, allowing an antibody domain as described herein to interact with an antibody-binding domain.

"Patient" or "subject in need thereof" refers to a living organism suffering from or prone to a disease or condition that can be treated by administration of a composition or pharmaceutical composition as provided herein. Non-limiting examples include humans, other mammals, bovines, rats, mice, dogs, monkeys, goat, sheep, cows, deer, and other non-mammalian animals. In some embodiments, a patient is human.

The terms "disease" or "condition" refer to a state of being or health status of a patient or subject capable of being treated with the compounds or methods provided herein. The disease may be a cancer. In some further instances, "cancer" refers to human cancers and carcinomas, sarcomas, adenocarcinomas, lymphomas, leukemias, including solid and lymphoid cancers, kidney, breast, lung, bladder, colon, ovarian, prostate, pancreas, stomach, brain, head and neck, skin, uterine, testicular, glioma, esophagus, and liver cancer, including hepatocarcinoma, lymphoma, including B-acute lymphoblastic lymphoma, non-Hodgkin's lymphomas (e.g., Burkitt's, Small Cell, and Large Cell lymphomas), Hodgkin's lymphoma, leukemia (including AML, ALL, and CML), or multiple myeloma.

As used herein, the term "cancer" refers to all types of cancer, neoplasm or malignant tumors found in mammals (e.g. humans), including leukemia, carcinomas and sarcomas. Exemplary cancers that may be treated with a compound or method provided herein include breast cancer, colon cancer, kidney cancer, leukemia, lung cancer, melanoma, ovarian cancer, prostate cancer, pancreatic cancer, brain cancer, liver cancer, gastric cancer or a sarcoma.

The term "leukemia" refers broadly to progressive, malignant diseases of the blood-forming organs and is generally characterized by a distorted proliferation and development of leukocytes and their precursors in the blood and bone marrow. Leukemia is generally clinically classified on the basis of (1) the duration and character of the disease-acute or chronic; (2) the type of cell involved; myeloid (myelogenous), lymphoid (lymphogenous), or monocytic; and (3) the increase or non-increase in the number abnormal cells in the blood-leukemic or aleukemic (subleukemic). Exemplary leukemias that may be treated with a compound or method provided herein include, for example, acute nonlymphocytic leukemia, chronic lymphocytic leukemia, acute granulocytic leukemia, chronic granulocytic leukemia, acute promyelocytic leukemia, adult T-cell leukemia, aleukemic leukemia, a leukocythemic leukemia, basophylic leukemia, blast cell leukemia, bovine leukemia, chronic myelocytic leukemia, leukemia cutis, embryonal leukemia, eosinophilic leukemia, Gross' leukemia, hairy-cell leukemia, hemoblastic leukemia, hemocytoblastic leukemia, histiocytic leukemia, stem cell leukemia, acute monocytic leukemia, leukopenic leukemia, lymphatic leukemia, lymphoblastic leukemia, lymphocytic leukemia, lymphogenous leukemia, lymphoid leukemia, lymphosarcoma cell leukemia, mast cell leukemia, megakaryocytic leukemia, micromyeloblastic leukemia, monocytic leukemia, myeloblastic leukemia, myelocytic leukemia, myeloid granulocytic leukemia, myelomonocytic leukemia, Naegeli leukemia, plasma cell leukemia, multiple myeloma, plasmacytic leukemia, promyelocytic leukemia, Rieder cell leukemia, Schilling's leukemia, stem cell leukemia, subleukemic leukemia, or undifferentiated cell leukemia.

The term "sarcoma" generally refers to a tumor which is made up of a substance like the embryonic connective tissue and is generally composed of closely packed cells embedded in a fibrillar or homogeneous substance. Sarcomas that may be treated with a compound or method provided herein include a chondrosarcoma, fibrosarcoma, lymphosarcoma, melanosarcoma, myxosarcoma, osteosarcoma, Abemethy's sarcoma, adipose sarcoma, liposarcoma, alveolar soft part sarcoma, ameloblastic sarcoma, botryoid sarcoma, chloroma sarcoma, chorio carcinoma, embryonal sarcoma, Wilms' tumor sarcoma, endometrial sarcoma, stromal sarcoma, Ewing's sarcoma, fascial sarcoma, fibroblastic sarcoma, giant cell sarcoma, granulocytic sarcoma, Hodgkin's sarcoma, idiopathic multiple pigmented hemorrhagic sarcoma, immunoblastic sarcoma of B cells, lymphoma, immunoblastic sarcoma of T-cells, Jensen's sarcoma, Kaposi's sarcoma, Kupffer cell sarcoma, angiosarcoma, leukosarcoma, malignant mesenchymoma sarcoma, parosteal sarcoma, reticulocytic sarcoma, Rous sarcoma, serocystic sarcoma, synovial sarcoma, or telangiectaltic sarcoma.

The term "melanoma" is taken to mean a tumor arising from the melanocytic system of the skin and other organs. Melanomas that may be treated with a compound or method provided herein include, for example, acral-lentiginous melanoma, amelanotic melanoma, benign juvenile melanoma, Cloudman's melanoma, S91 melanoma, Harding-Passey melanoma, juvenile melanoma, lentigo maligna melanoma, malignant melanoma, nodular melanoma, subungal melanoma, or superficial spreading melanoma.

The term "carcinoma" refers to a malignant new growth made up of epithelial cells tending to infiltrate the surrounding tissues and give rise to metastases. Exemplary carcinomas that may be treated with a compound or method provided herein include, for example, medullary thyroid carcinoma, familial medullary thyroid carcinoma, acinar carcinoma, acinous carcinoma, adenocystic carcinoma, adenoid cystic carcinoma, carcinoma adenomatosum, carcinoma of adrenal cortex, alveolar carcinoma, alveolar cell carcinoma, basal cell carcinoma, carcinoma basocellulare, basaloid carcinoma, basosquamous cell carcinoma, bronchioalveolar carcinoma, bronchiolar carcinoma, bronchogenic carcinoma, cerebriform carcinoma, cholangiocellular carcinoma, chorionic carcinoma, colloid carcinoma, comedo carcinoma, corpus carcinoma, cribriform carcinoma, carcinoma en cuirasse, carcinoma cutaneum, cylindrical carcinoma, cylindrical cell carcinoma, duct carcinoma, carcinoma durum, embryonal carcinoma, encephaloid carcinoma, epiermoid carcinoma, carcinoma epitheliale adenoides, exophytic carcinoma, carcinoma ex ulcere, carcinoma fibrosum, gelatiniforni carcinoma, gelatinous carcinoma, giant cell carcinoma, carcinoma gigantocellulare, glandular carcinoma, granulosa cell carcinoma, hair-matrix carcinoma, hematoid carcinoma, hepatocellular carcinoma, Hurthle cell carcinoma, hyaline carcinoma, hypernephroid carcinoma, infantile embryonal carcinoma, carcinoma in situ, intraepidermal carcinoma, intraepithelial carcinoma, Krompecher's carcinoma, Kulchitzky-cell carcinoma, large-cell carcinoma, lenticular carcinoma, carcinoma lenticulare, lipomatous carcinoma, lymphoepithelial carcinoma, carcinoma medullare, medullary carcinoma, melanotic carcinoma, carcinoma molle, mucinous carcinoma, carcinoma muciparum, carcinoma mucocellulare, mucoepidermoid carcinoma, carcinoma mucosum, mucous carcinoma, carcinoma myxomatodes, nasopharyngeal carcinoma, oat cell carcinoma, carcinoma ossificans, osteoid carcinoma, papillary carcinoma, periportal carcinoma, preinvasive carcinoma, prickle cell carcinoma, pultaceous carcinoma, renal cell carcinoma of kidney, reserve cell carcinoma, carcinoma sarcomatodes, schneiderian carcinoma, scirrhous carcinoma, carcinoma scroti, signet-ring cell carcinoma, carcinoma simplex, small-cell carcinoma, solanoid carcinoma, spheroidal cell carcinoma, spindle cell carcinoma, carcinoma spongiosum, squamous carcinoma, squamous cell carcinoma, string carcinoma, carcinoma telangiectaticum, carcinoma telangiectodes, transitional cell carcinoma, carcinoma tuberosum, tuberous carcinoma, verrucous carcinoma, or carcinoma villosum.

The term "associated" or "associated with" in the context of a substance or substance activity or function associated with a disease (e.g., cancer, asthma, ulcerative colitis, irritable bowel syndrome, arthritis, uveitis, pyoderma gangrenosum, or erythema nodosum) is caused by (in whole or in part), or a symptom of the disease is caused by (in whole or in part) the substance or substance activity or function.

As defined herein the terms "immune checkpoint", "immune checkpoint protein" or "checkpoint protein" may be used interchangeably and refer to compositions (molecules) capable of modulating the duration and amplitude of physiological immune responses (e.g., attenuate and/or eliminate sustained immune cell activation, hus regulating normal immune homeostasis).

Immune checkpoint proteins may stimulate (increase) an immune response. In embodiments, the checkpoint protein is a cellular receptor. Examples, of stimulatory checkpoint molecules include, but are not limited to, members of the tumor necrosis factor (TNF) receptor superfamily (e.g. CD27, CD40, OX40, glucocorticoid-induced TNFR family related gene (GITR), and CD137), members of the B7-CD28 superfamily (e.g. CD28 itself and Inducible T-cell costimulator (ICOS)). Alternatively, immune checkpoint proteins may inhibit (decrease) an immune response. Examples of inhibitory checkpoint molecules include, but are not limited to, adenosine A2A receptor (A2AR), B7-H3, B7-H4, BTLA, CTLA-4, indoleamine 2,3-dioxygenase (IDO), killer immunoglobulin-like receptors (KIR), LAG3, PD-1, TIM-3, and V-domain immunoglobulin suppressor of T-cell activation (VISTA) protein.

Likewise, an "immune checkpoint inhibitor" or "checkpoint inhibitor" as provided herein refers to a substance (e.g., an antibody or fragment thereof, a small molecule) that is capable of inhibiting, negatively affecting (e.g., decreasing) the activity or function of a checkpoint protein (e.g., decreasing expression or decreasing the activity of a checkpoint protein) relative to the activity or function of the checkpoint protein in the absence of the inhibitor. The checkpoint inhibitor may at least in part, partially or totally block stimulation, decrease, prevent, or delay activation, or inactivate, desensitize, or down-regulate signal transduction or enzymatic activity or the amount of a checkpoint protein. A checkpoint inhibitor may inhibit a checkpoint protein, e.g., by binding, partially or totally blocking, decreasing, preventing, delaying, inactivating, desensitizing, or down-regulating activity of the checkpoint protein. In embodiments, the checkpoint inhibitor is an antibody. In embodiments, the checkpoint inhibitor is an antibody fragment. In embodiments, the checkpoint inhibitor is an antibody variant. In embodiments, the checkpoint inhibitor is a scFv. In embodiments, the checkpoint inhibitor is an anti-CTLA-4 antibody. In embodiments, the checkpoint inhibitor is an anti-PD1 antibody. In embodiments, the checkpoint inhibitor is an anti-PD-L1 antibody. In embodiments, the checkpoint inhibitor is an anti-LAG-3 antibody. In embodiments, the checkpoint inhibitor is an anti-IgG1k antibody. In embodiments, the checkpoint inhibitor is an anti-CD25 antibody. In embodiments, the checkpoint inhibitor is an anti-IL2R antibody. In embodiments, the checkpoint inhibitor forms part of an oncolytic virus. Non-limiting examples of checkpoint inhibitors include ipilimumab, pembrolizumab, nivolumab, talimogene laherparepvec, durvalumab, daclizumab, avelumab, and atezolizumab.

The term "aberrant" as used herein refers to different from normal. When used to describe enzymatic activity, aberrant refers to activity that is greater or less than a normal control or the average of normal non-diseased control samples. Aberrant activity may refer to an amount of activity that results in a disease, wherein returning the aberrant activity to a normal or non-disease-associated amount (e.g. by using a method as described herein), results in reduction of the disease or one or more disease symptoms.

A "control" or "standard control" refers to a sample, measurement, or value that serves as a reference, usually a known reference, for comparison to a test sample, measurement, or value. For example, a test sample can be taken from a patient suspected of having a given disease (e.g. cancer) and compared to a known normal (non-diseased) individual (e.g. a standard control subject). A standard control can also represent an average measurement or value gathered from a population of similar individuals (e.g. standard control subjects) that do not have a given disease (i.e. standard control population), e.g., healthy individuals with a similar medical background, same age, weight, etc. A standard control value can also be obtained from the same individual, e.g. from an earlier-obtained sample from the patient prior to disease onset. For example, a control can be devised to compare therapeutic benefit based on pharmacological data (e.g., half-life) or therapeutic measures (e.g., comparison of side effects). Controls are also valuable for determining the significance of data. For example, if values for a given parameter are widely variant in controls, variation in test samples will not be considered as significant. One of skill will recognize that standard controls can be designed for assessment of any number of parameters (e.g. RNA levels, protein levels, specific cell types, specific bodily fluids, specific tissues, synoviocytes, synovial fluid, synovial tissue, fibroblast-like synoviocytes, macrophagelike synoviocytes, etc).

One of skill in the art will understand which standard controls are most appropriate in a given situation and be able to analyze data based on comparisons to standard control values. Standard controls are also valuable for determining the significance (e.g. statistical significance) of data. For example, if values for a given parameter are widely variant in standard controls, variation in test samples will not be considered as significant.

The term "diagnosis" refers to a relative probability that a disease (e.g. cancer) is present in the subject. Similarly, the term "prognosis" refers to a relative probability that a certain future outcome may occur in the subject with respect to a disease state. For example, in the context of the present invention, prognosis can refer to the likelihood that an individual will develop a disease (e.g. cancer), or the likely severity of the disease (e.g., duration of disease). The terms are not intended to be absolute, as will be appreciated by any one of skill in the field of medical diagnostics.

"Biological sample" or "sample" refer to materials obtained from or derived from a subject or patient. A biological sample includes sections of tissues such as biopsy and autopsy samples, and frozen sections taken for histological purposes. Such samples include bodily fluids such as blood and blood fractions or products (e.g., serum, plasma, platelets, red blood cells, and the like), sputum, tissue, cultured cells (e.g., primary cultures, explants, and transformed cells) stool, urine, synovial fluid, joint tissue, synovial tissue, synoviocytes, fibroblast-like synoviocytes, macrophage-like synoviocytes, immune cells, hematopoietic cells, fibroblasts, macrophages, T cells, etc. A biological sample is typically obtained from a eukaryotic organism, such as a mammal such as a primate e.g., chimpanzee or human; cow; dog; cat; a rodent, e.g., guinea pig, rat, mouse; rabbit; or a bird; reptile; or fish.

A "cell" as used herein, refers to a cell carrying out metabolic or other functions sufficient to preserve or replicate its genomic DNA. A cell can be identified by well-known methods in the art including, for example, presence of an intact membrane, staining by a particular dye, ability to produce progeny or, in the case of a gamete, ability to combine with a second gamete to produce a viable offspring. Cells may include prokaryotic and eukaroytic cells. Prokaryotic cells include but are not limited to bacteria. Eukaryotic cells include but are not limited to yeast cells and cells derived from plants and animals, for example mammalian, insect (e.g., spodoptera) and human cells. Cells may be useful when they are naturally nonadherent or have been treated not to adhere to surfaces, for example by trypsinization.

The term "replicate" is used in accordance with its plain ordinary meaning and refers to the ability of a cell or virus to produce progeny. A person of ordinary skill in the art will immediately understand that the term replicate when used in connection with DNA, refers to the biological process of producing two identical replicas of DNA from one original DNA molecule. Thus, the term "replicate" includes passaging and re-infecting progeny cells. In embodiments, the chimeric poxvirus provided herein has an increased oncolytic activity compared to its parental virus. In embodiments, the oncolytic activity (ability to induce cell death in an infected cell) is more than 1.5, 2, 3, 4, 5, 6, 7, 8, 9, 10, 100, 10000, 10000 times increased compared to the oncolytic activity of a parental virus (one of the viruses used to form the chimeric virus provided herein).

A "synergistic amount" as used herein refers to the sum of a first amount (e.g., an amount of a first chimeric poxvirus) and a second amount (e.g., an amount of a second chimeric poxvirus) that results in a synergistic effect (i.e. an effect greater than an additive effect). Therefore, the terms "synergy", "synergism", "synergistic", "combined synergistic amount", and "synergistic therapeutic effect" which are used herein interchangeably, refer to a measured effect of the chimeric poxviruses administered in combination where the measured effect is greater than the sum of the individual effects of each of the chimeric poxviruses administered alone as a single agent.

In embodiments, a synergistic amount may be about 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.4, 2.5, 2.6, 2.7, 2.8, 2.9, 3.0, 3.1, 3.2, 3.3, 3.4, 3.5, 3.6, 3.7, 3.8, 3.9, 4.0, 4.1, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.1, 6.2, 6.3, 6.4, 6.5, 6.6, 6.7, 6.8, 6.9, 7.0, 7.1, 7.2, 7.3, 7.4, 7.5, 7.6, 7.7, 7.8, 7.9, 8.0, 8.1, 8.2, 8.3, 8.4, 8.5, 8.6, 8.7, 8.8, 8.9, 9.0, 9.1, 9.2, 9.3, 9.4, 9.5, 9.6, 9.7, 9.8, 9.9, 10.0, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99% of the amount of the first chimeric poxvirus when used separately from the second chimeric poxvirus. In embodiments, a synergistic amount may be about 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.4, 2.5, 2.6, 2.7, 2.8, 2.9, 3.0, 3.1, 3.2, 3.3, 3.4, 3.5, 3.6, 3.7, 3.8, 3.9, 4.0, 4.1, 4.2, 4.3, 4.4, 4.5, 4.6, 4.7, 4.8, 4.9, 5.0, 5.1, 5.2, 5.3, 5.4, 5.5, 5.6, 5.7, 5.8, 5.9, 6.0, 6.1, 6.2, 6.3, 6.4, 6.5, 6.6, 6.7, 6.8, 6.9, 7.0, 7.1, 7.2, 7.3, 7.4, 7.5, 7.6, 7.7, 7.8, 7.9, 8.0, 8.1, 8.2, 8.3, 8.4, 8.5, 8.6, 8.7, 8.8, 8.9, 9.0, 9.1, 9.2, 9.3, 9.4, 9.5, 9.6, 9.7, 9.8, 9.9, 10.0, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99% of the amount of the second chimeric poxvirus when used separately from the first chimeric poxvirus.

The terms "virus" or "virus particle" are used according to its plain ordinary meaning within Virology and refers to a virion including the viral genome (e.g. DNA, RNA, single strand, double strand), viral capsid and associated proteins, and in the case of enveloped viruses (e.g. herpesvirus, poxvirus), an envelope including lipids and optionally components of host cell membranes, and/or viral proteins.

The term "poxvirus" is used according to its plain ordinary meaning within Virology and refers to a member of Poxviridae family capable of infecting vertebrates and invertebrates which replicate in the cytoplasm of their host. In embodiments, poxvirus virions have a size of about 200 nm in diameter and about 300 nm in length and possess a genome in a single, linear, double-stranded segment of DNA, typically 130-375 kilobase. The term poxvirus includes, without limitation, all genera of poxviridae (e.g., betaentomopoxvirus, yatapoxvirus, cervidpoxvirus, gammaentomopoxvirus, leporipoxvirus, suipoxvirus, molluscipoxvirus, crocodylidpoxvirus, alphaentomopoxvirus, capripoxvirus, orthopoxvirus, avipoxvirus, and parapoxvirus). In embodiments, the poxvirus is an orthopoxvirus (e.g., smallpox virus, vaccinia virus, cowpox virus, monkeypox virus), parapoxvirus (e.g., orf virus, pseudocowpox virus, bovine popular stomatitis virus), yatapoxvirus (e.g., tanapox virus, yaba monkey tumor virus) or molluscipoxvirus (e.g., molluscum contagiosum virus). In embodiments, the poxvirus is an orthopoxvirus (e.g., cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, or vaccinia virus strain AS). In embodiments, the poxvirus is a parapoxvirus (e.g., orf virus strain NZ2 or pseudocowpox virus strain TJS).

The term "chimeric" used within the context of a chimeric poxvirus, is used according to its plain ordinary meaning within Virology and refers to a hybrid microorganism (e.g., chimeric poxvirus) created by joining nucleic acid fragments from two or more different microorganisms (e.g., two viruses from the same subfamily, two viruses from different subfamilies). In embodiments, the nucleic acid fragments from at least two poxvirus strains combined contain the essential genes necessary for replication. In embodiments, the nucleic acid fragments from one of the at least two poxvirus strains contain the essential genes necessary for replication. The chimeric poxvirus provided herein including embodiments thereof may include one or more transgenes (i.e., nucleic acid sequences not native to the viral genome). For example, the chimeric poxvirus provided herein including embodiments thereof may include an anti-cancer nucleic acid sequence, a nucleic acid binding sequence, a detectable moiety-encoding nucleic acid sequence or any combination thereof. In embodiments, the chimeric poxvirus includes a nucleic acid sequence including an anti-cancer nucleic acid sequence, a nucleic acid binding sequence and a detectable moiety-encoding nucleic acid sequence. In embodiments, the chimeric poxvirus includes a nucleic acid sequence including an anti-cancer nucleic acid sequence and a detectable moiety-encoding nucleic acid sequence. In embodiments, the chimeric poxvirus includes a nucleic acid sequence including a nucleic acid binding sequence and a detectable moiety-encoding nucleic acid sequence. In embodiments, the chimeric poxvirus includes a nucleic acid sequence including an anti-cancer nucleic acid sequence and a nucleic acid binding sequence.

The term "plaque forming units" is used according to its plain ordinary meaning in Virology and refers to the amount of plaques in a cell monolayer that can be formed per volume of viral particles. In some embodiments the units are based on the number of plaques that could form when infecting a monolayer of susceptible cells. For example, in embodiments 1,000 PFU/μl indicates that 1 μl of a solution including viral particles contains enough virus particles to produce 1000 infectious plaques in a cell monolayer. In embodiments, plaque forming units are abbreviated "PFU".

The terms "multiplicity of infection" or "MOI" are used according to its plain ordinary meaning in Virology and refers to the ratio of infectious agent (e.g., poxvirus) to the target (e.g., cell) in a given area or volume. In embodiments, the area or volume is assumed to be homogenous.

The term "cowpox virus strain Brighton" is used according to its common, ordinary meaning and refers to virus strains of the same or similar names and functional fragments and homologs thereof. The term includes recombinant or naturally occurring forms of cowpox virus strain Brighton or variants thereof that maintain cowpox virus strain Brighton activity (e.g. within at least 30%, 40%, 50%, 60%, 70%, 80%, 90%, 95%, or 100%). The term includes recombinant or naturally occurring forms of cowpox virus strain Brighton or variants thereof whose genome has sequence identity to the cowpox virus strain Brighton genome (e.g. about 65%, 70%, 75%, 80%, 85%, 90%, 95%, 99% or 100% identity to the cowpox virus strain Brighton genome). Cowpox virus strain Brighton may refer to variants having mutated amino acid residues that modulate (e.g. increase or decrease when compared to cowpox virus strain Brighton) cowpox virus strain Brighton activity, expression, cellular targeting, or infectivity. Cowpox virus strain Brighton may be modified as described herein. In embodiments, the cowpox virus strain Brighton refers to the virus strain identified by ATCC (American Type Culture Collection) reference number ATCC VR-302™, variants or homologs thereof. In embodiments, the cowpox virus strain Brighton refers to the virus strain identified by Taxonomy reference number 265872, variants or homologs thereof.

The term "raccoonpox virus strain Herman" is used according to its common, ordinary meaning and refers to virus strains of the same or similar names and functional fragments and homologs thereof. The term includes recombinant or naturally occurring forms of raccoonpox virus strain Herman or variants thereof that maintain raccoonpox virus strain Herman activity (e.g. within at least 30%, 40%, 50%, 60%, 70%, 80%, 90%, 95%, or 100%). The term includes recombinant or naturally occurring forms of raccoonpox virus strain Herman or variants thereof whose genome has sequence identity to the raccoonpox virus strain Herman genome (e.g. about 65%, 70%, 75%, 80%, 85%, 90%, 95%, 99% or 100% identity to the raccoonpox virus strain Herman genome). Raccoonpox virus strain Herman may refer to variants having mutated amino acid residues that modulate (e.g. increase or decrease when compared to raccoonpox virus strain Herman) raccoonpox virus strain Herman activity, expression, cellular targeting, or infectivity. Raccoonpox virus strain Herman may be modified as described herein. In embodiments, the raccoonpox virus strain Herman refers to the virus strain identified by ATCC reference number ATCC VR838™, variants or homologs thereof. In embodiments, the raccoonpox virus strain Herman refers to the virus strain encoded by the nucleic acid sequence with the reference number NC_027213.

The term "rabbitpox virus strain Utrecht" is used according to its common, ordinary meaning and refers to virus strains of the same or similar names and functional fragments and homologs thereof. The term includes recombinant or naturally occurring forms of rabbitpox virus strain Utrecht or variants thereof that maintain rabbitpox virus strain Utrecht activity (e.g. within at least 30%, 40%, 50%, 60%, 70%, 80%, 90%, 95%, or 100%). The term includes recombinant or naturally occurring forms of rabbitpox virus strain Utrecht or variants thereof whose genome has sequence identity to the rabbitpox virus strain Utrecht genome (e.g. about 65%, 70%, 75%, 80%, 85%, 90%, 95%, 99% or 100% identity to the rabbitpox virus strain Utrecht genome). Rabbitpox virus strain Utrecht may refer to variants having mutated amino acid residues that modulate (e.g. increase or decrease when compared to rabbitpox virus strain Utrecht) rabbitpox virus strain Utrecht activity, expression, cellular targeting, or infectivity. Rabbitpox virus strain Utrecht may be modified as described herein. In embodiments, the rabbitpox virus strain Utrecht refers to the virus strain identified by ATCC reference number ATCC VR-1591™, variants or homologs thereof. In embodiments, the rabbitpox virus strain Utrecht refers to the virus strain identified by Taxonomy reference number 45417, variants or homologs thereof.

The term "vaccinia virus strain WR" is used according to its common, ordinary meaning and refers to virus strains of the same or similar names and functional fragments and homologs thereof. The term includes recombinant or naturally occurring forms of vaccinia virus strain WR or variants thereof that maintain vaccinia virus strain WR activity (e.g. within at least 30%, 40%, 50%, 60%, 70%, 80%, 90%, 95%, or 100%). The term includes recombinant or naturally occurring forms of vaccinia virus strain WR or variants thereof whose genome has sequence identity to the vaccinia virus strain WR genome (e.g. about 65%, 70%, 75%, 80%, 85%, 90%, 95%, 99% or 100% identity to the vaccinia virus strain WR genome). Vaccinia virus strain WR may refer to variants having mutated amino acid residues that modulate (e.g. increase or decrease when compared to vaccinia virus strain WR) vaccinia virus strain WR activity, expression, cellular targeting, or infectivity. Vaccinia virus strain WR may be modified as described herein. In embodiments, the vaccinia virus strain WR refers to the virus strain identified by ATCC reference number ATCC VR1354™, variants or homologs thereof. In embodiments, the vaccinia virus strain WR refers to the virus strain identified by Taxonomy reference number 10254, variants or homologs thereof.

The term "vaccinia virus strain IHD" is used according to its common, ordinary meaning and refers to virus strains of the same or similar names and functional fragments and homologs thereof. The term includes recombinant or naturally occurring forms of vaccinia virus strain IHD or variants thereof that maintain vaccinia virus strain IHD activity (e.g. within at least 30%, 40%, 50%, 60%, 70%, 80%, 90%, 95%, or 100%). The term includes recombinant or naturally occurring forms of vaccinia virus strain IHD or variants thereof whose genome has sequence identity to the vaccinia virus strain IHD genome (e.g. about 65%, 70%, 75%, 80%, 85%, 90%, 95%, 99% or 100% identity to the vaccinia virus strain IHD genome). Vaccinia virus strain IHD may refer to variants having mutated amino acid residues that modulate (e.g. increase or decrease when compared to vaccinia virus strain IHD) vaccinia virus strain IHD activity, expression, cellular targeting, or infectivity. Vaccinia virus strain DID may be modified as described herein. In embodiments, the vaccinia virus strain IHD refers to the virus strain identified by ATCC reference number ATCC VR156™, variants or homologs thereof. In embodiments, the vaccinia virus strain IHD refers to the virus strain identified by Taxonomy reference number 10251, variants or homologs thereof.

The term "vaccinia virus strain Elstree" is used according to its common, ordinary meaning and refers to virus strains of the same or similar names and functional fragments and homologs thereof. The term includes recombinant or naturally occurring forms of vaccinia virus strain Elstree or variants thereof that maintain vaccinia virus strain Elstree activity (e.g. within at least 30%, 40%, 50%, 60%, 70%, 80%, 90%, 95%, or 100%). The term includes recombinant or naturally occurring forms of vaccinia virus strain Elstree or variants thereof whose genome has sequence identity to the vaccinia virus strain Elstree genome (e.g. about 65%, 70%, 75%, 80%, 85%, 90%, 95%, 99% or 100% identity to the vaccinia virus strain Elstree genome). Vaccinia virus strain Elstree may refer to variants having mutated amino acid residues that modulate (e.g. increase or decrease when compared to vaccinia virus strain Elstre) vaccinia virus strain Elstree activity, expression, cellular targeting, or infectivity. Vaccinia virus strain Elstree may be modified as described herein. In embodiments, the vaccinia virus strain Elstree refers to the virus strain identified by ATCC reference number ATCC VR1549™, variants or homologs thereof.

The term "vaccinia virus strain CL" is used according to its common, ordinary meaning and refers to virus strains of the same or similar names and functional fragments and homologs thereof. The term includes recombinant or naturally occurring forms of vaccinia virus strain CL or variants thereof that maintain vaccinia virus strain CL activity (e.g. within at least 30%, 40%, 50%, 60%, 70%, 80%, 90%, 95%, or 100%). The term includes recombinant or naturally occurring forms of vaccinia virus strain CL or variants thereof whose genome has sequence identity to the vaccinia virus strain CL genome (e.g. about 65%, 70%, 75%, 80%, 85%, 90%, 95%, 99% or 100% identity to the vaccinia virus strain CL genome). Vaccinia virus strain CL may refer to variants having mutated amino acid residues that modulate (e.g. increase or decrease when compared to vaccinia virus strain CL) vaccinia virus strain CL activity, expression, cellular targeting, or infectivity. Vaccinia virus strain CL may be modified as described herein. In embodiments, the vaccinia virus strain CL refers to the virus strain identified by ATCC reference number ATCC VR1774™, variants or homologs thereof.

The term "vaccinia virus strain Lederle-Chorioallantoic" is used according to its common, ordinary meaning and refers to virus strains of the same or similar names and functional fragments and homologs thereof. The term includes recombinant or naturally occurring forms of vaccinia virus strain Lederle-Chorioallantoic or variants thereof that maintain vaccinia virus strain Lederle-Chorioallantoic activity (e.g. within at least 30%, 40%, 50%, 60%, 70%, 80%, 90%, 95%, or 100%). The term includes recombinant or naturally occurring forms of vaccinia virus strain Lederle-Chorioallantoic or variants thereof whose genome has sequence identity to the vaccinia virus strain Lederle-Chorioallantoic genome (e.g. about 65%, 70%, 75%, 80%, 85%, 90%, 95%, 99% or 100% identity to the vaccinia virus strain Lederle-Chorioallantoic genome). Vaccinia virus strain Lederle-Chorioallantoic may refer to variants having mutated amino acid residues that modulate (e.g. increase or decrease when compared to vaccinia virus strain Lederle-Chorioallantoic) vaccinia virus strain Lederle-Chorioallantoic activity, expression, cellular targeting, or infectivity. Vaccinia virus strain Lederle-Chorioallantoic may be modified as described herein. In embodiments, the vaccinia virus strain Lederle-Chorioallantoic refers to the virus strain identified by ATCC reference number ATCC VR118™, variants or homologs thereof.

The term "vaccinia virus strain AS" is used according to its common, ordinary meaning and refers to virus strains of the same or similar names and functional fragments and homologs thereof. The term includes recombinant or naturally occurring forms of vaccinia virus strain AS or variants thereof that maintain vaccinia virus strain AS activity (e.g. within at least 30%, 40%, 50%, 60%, 70%, 80%, 90%, 95%, or 100%). The term includes recombinant or naturally occurring forms of vaccinia virus strain AS or variants thereof whose genome has sequence identity to the vaccinia virus strain AS genome (e.g. about 65%, 70%, 75%, 80%, 85%, 90%, 95%, 99% or 100% identity to the vaccinia virus strain AS genome). Vaccinia virus strain AS may refer to variants having mutated amino acid residues that modulate (e.g. increase or decrease when compared to vaccinia virus strain AS) vaccinia virus strain AS activity, expression, cellular targeting, or infectivity. Vaccinia virus strain AS may be modified as described herein. In embodiments, the vaccinia virus strain AS refers to the virus strain identified by ATCC reference number ATCC VR2010™, variants or homologs thereof.

The term "orf virus strain NZ2" is used according to its common, ordinary meaning and refers to virus strains of the same or similar names and functional fragments and homologs thereof. The term includes recombinant or naturally occurring forms of orf virus strain NZ2 or variants thereof that maintain orf virus strain NZ2 activity (e.g. within at least 30%, 40%, 50%, 60%, 70%, 80%, 90%, 95%, or 100%). The term includes recombinant or naturally occurring forms of orf virus strain NZ2 or variants thereof whose genome has sequence identity to the orf virus strain NZ2 genome (e.g. about 65%, 70%, 75%, 80%, 85%, 90%, 95%, 99% or 100% identity to the orf virus strain NZ2 genome). Orf virus strain NZ2 may refer to variants having mutated amino acid residues that modulate (e.g. increase or decrease when compared to orf virus strain NZ2) orf virus strain NZ2 activity, expression, cellular targeting, or infectivity. Orf virus strain NZ2 may be modified as described herein. In embodiments, the orf virus strain NZ2 refers to the virus strain identified by ATCC reference number ATCC VR-1548™, variants or homologs thereof. In embodiments, the orf virus strain NZ2 refers to the virus strain identified by Taxonomy reference number 10259, variants or homologs thereof.

The term "pseudocowpox virus strain TJS" is used according to its common, ordinary meaning and refers to virus strains of the same or similar names and functional fragments and homologs thereof. The term includes recombinant or naturally occurring forms of pseudocowpox virus strain TJS or variants thereof that maintain pseudocowpox virus strain TJS activity (e.g. within at least 30%, 40%, 50%, 60%, 70%, 80%, 90%, 95%, or 100%). The term includes recombinant or naturally occurring forms of pseudocowpox virus strain TJS or variants thereof whose genome has sequence identity to the pseudocowpox virus strain TJS genome (e.g. about 65%, 70%, 75%, 80%, 85%, 90%, 95%, 99% or 100% identity to the pseudocowpox virus strain TJS genome). Pseudocowpox virus strain TJS may refer to variants having mutated amino acid residues that modulate (e.g. increase or decrease when compared to pseudocowpox virus strain TJS) pseudocowpox virus strain TJS activity, expression, cellular targeting, or infectivity. Pseudocowpox virus strain TJS may be modified as described herein. In embodiments, the pseudocowpox virus strain TJS refers to the virus strain identified by ATCC reference number ATCC VR-634™, variants or homologs thereof.

In embodiments, cowpox virus strain Brighton is cowpox virus strain Brighton ATCC VR-302™. In embodiments, raccoonpox virus strain Herman is raccoonpox virus strain Herman ATCC VR838™. In embodiments, rabbitpox virus strain Utrecht is rabbitpox virus strain Utrecht ATCC VR-1591™. In embodiments, vaccinia virus strain WR is vaccinia virus strain WR ATCC VR1354™. In embodiments, vaccinia virus strain IHD is vaccinia virus strain IHD ATCC VR156™. In embodiments, vaccinia virus strain Elstree is vaccinia virus strain Elstree ATCC VR1549™. In embodiments, vaccinia virus strain CL is vaccinia virus strain CL ATCC VR1774™. In embodiments, vaccinia virus strain Lederle-Chorioallantoic is vaccinia virus strain Lederle-Chorioallantoic ATCC VR118™. In embodiments, vaccinia virus strain AS is vaccinia virus strain AS ATCC VR2010™. In embodiments, orf virus strain NZ2 is orf virus strain NZ2 ATCC VR1548™. In embodiments, pseudocowpox virus strain TJS is pseudocowpox virus strain TJS ATCC VR634™. In embodiments, the cowpox virus strain Brighton refers to the virus strain identified by Taxonomy reference number 265872, variants or homologs thereof.

In this disclosure, "comprises," "comprising," "containing" and "having" and the like can have the meaning ascribed to them in U.S. Patent law and can mean "includes," "including," and the like. "Consisting essentially of" or "consists essentially" likewise has the meaning ascribed in U.S. Patent law and the term is open-ended, allowing for the presence of more than that which is recited so long as basic or novel characteristics of that which is recited is not changed by the presence of more than that which is recited, but excludes prior art embodiments.

II. Viral Compositions

In an aspect, is provided a chimeric poxvirus including a nucleic acid sequence having a sequence identity of at least 70% to SEQ ID NO:1 or SEQ ID NO:2, wherein the nucleic acid sequence includes nucleic acid fragments from at least two poxvirus strains selected from the group including cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS.

The chimeric poxviruses as described herein may include transgenes. As used herein, a "transgene" refers to a nucleic acid sequence that originates from outside a given cell, organism or virus. A transgene as provided herein is therefore not native to, or originates within a poxvirus. A transgene as provided may encode a protein or may be a non-coding nucleic acid sequence. Transgenes provided herein may include anti-cancer nucleic acid sequences (e.g., nucleic acid binding sequences and nucleic acid sequences that encode for polypeptides useful for the treatment of cancer) or detectable moiety-encoding nucleic acid sequences. Thus, in embodiments, the chimeric poxvirus described herein includes one or more anti-cancer nucleic acid sequences or a detectable moiety-encoding nucleic acid sequence. In embodiments, the chimeric poxvirus described herein includes one or more anti-cancer nucleic acid sequences and a detectable moiety-encoding nucleic acid sequence.

In embodiments, the nucleic acid sequence has a sequence identity of at least 71% to SEQ ID NO:1. In embodiments, the nucleic acid sequence has a sequence identity of at least 72% to SEQ ID NO:1. In embodiments, the nucleic acid sequence has a sequence identity of at least 73% to SEQ ID NO:1. In embodiments, the nucleic acid sequence has a sequence identity of at least 74% to SEQ ID NO:1. In embodiments, the nucleic acid sequence has a sequence identity of at least 75% to SEQ ID NO:1. In embodiments, the nucleic acid sequence has a sequence identity of at least 76% to SEQ ID NO:1. In embodiments, the nucleic acid sequence has a sequence identity of at least 77% to SEQ ID NO:1. In embodiments, the nucleic acid sequence has a sequence identity of at least 78% to SEQ ID NO:1. In embodiments, the nucleic acid sequence has a sequence identity of at least 79% to SEQ ID NO:1. In embodiments, the nucleic acid sequence has a sequence identity of at least 80% to SEQ ID NO:1.

In embodiments, the nucleic acid sequence has a sequence identity of at least 81% to SEQ ID NO:1. In embodiments, the nucleic acid sequence has a sequence identity of at least 82% to SEQ ID NO:1. In embodiments, the nucleic acid sequence has a sequence identity of at least 83% to SEQ ID NO:1. In embodiments, the nucleic acid sequence has a sequence identity of at least 84% to SEQ ID NO:1. In embodiments, the nucleic acid sequence has a sequence identity of at least 85% to SEQ ID NO:1. In embodiments, the nucleic acid sequence has a sequence identity of at least 86% to SEQ ID NO:1. In embodiments, the nucleic acid sequence has a sequence identity of at least 87% to SEQ ID NO:1. In embodiments, the nucleic acid sequence has a sequence identity of at least 88% to SEQ ID NO:1. In embodiments, the nucleic acid sequence has a sequence identity of at least 89% to SEQ ID NO:1. In embodiments, the nucleic acid sequence has a sequence identity of at least 90% to SEQ ID NO:1.

In embodiments, the nucleic acid sequence has a sequence identity of at least 91% to SEQ ID NO:1. In embodiments, the nucleic acid sequence has a sequence identity of at least 92% to SEQ ID NO:1. In embodiments, the nucleic acid sequence has a sequence identity of at least 93% to SEQ ID NO:1. In embodiments, the nucleic acid sequence has a sequence identity of at least 94% to SEQ ID NO:1. In embodiments, the nucleic acid sequence has a sequence identity of at least 95% to SEQ ID NO:1. In embodiments, the nucleic acid sequence has a sequence identity of at least 96% to SEQ ID NO:1. In embodiments, the nucleic acid sequence has a sequence identity of at least 97% to SEQ ID NO:1. In embodiments, the nucleic acid sequence has a sequence identity of at least 98% to SEQ ID NO:1. In embodiments, the nucleic acid sequence has a sequence identity of at least 99% to SEQ ID NO:1.

In embodiments, the nucleic acid sequence has a sequence identity of at least 71% to SEQ ID NO:2. In embodiments, the nucleic acid sequence has a sequence identity of at least 72% to SEQ ID NO:2. In embodiments, the nucleic acid sequence has a sequence identity of at least 73% to SEQ ID NO:2. In embodiments, the nucleic acid sequence has a sequence identity of at least 74% to SEQ ID NO:2. In embodiments, the nucleic acid sequence has a sequence identity of at least 75% to SEQ ID NO:2. In embodiments, the nucleic acid sequence has a sequence identity of at least 76% to SEQ ID NO:2. In embodiments, the nucleic acid sequence has a sequence identity of at least 77% to SEQ ID NO:2. In embodiments, the nucleic acid sequence has a sequence identity of at least 78% to SEQ ID NO:2. In embodiments, the nucleic acid sequence has a sequence identity of at least 79% to SEQ ID NO:2. In embodiments, the nucleic acid sequence has a sequence identity of at least 80% to SEQ ID NO:2.

In embodiments, the nucleic acid sequence has a sequence identity of at least 81% to SEQ ID NO:2. In embodiments, the nucleic acid sequence has a sequence identity of at least 82% to SEQ ID NO:2. In embodiments, the nucleic acid sequence has a sequence identity of at least 83% to SEQ ID NO:2. In embodiments, the nucleic acid sequence has a sequence identity of at least 84% to SEQ ID NO:2. In embodiments, the nucleic acid sequence has a sequence identity of at least 85% to SEQ ID NO:2. In embodiments, the nucleic acid sequence has a sequence identity of at least 86% to SEQ ID NO:2. In embodiments, the nucleic acid sequence has a sequence identity of at least 87% to SEQ ID NO:2. In embodiments, the nucleic acid sequence has a sequence identity of at least 88% to SEQ ID NO:2. In embodiments, the nucleic acid sequence has a sequence identity of at least 89% to SEQ ID NO:2. In embodiments, the nucleic acid sequence has a sequence identity of at least 90% to SEQ ID NO:2.

In embodiments, the nucleic acid sequence has a sequence identity of at least 91% to SEQ ID NO:2. In embodiments, the nucleic acid sequence has a sequence identity of at least 92% to SEQ ID NO:2. In embodiments, the nucleic acid sequence has a sequence identity of at least 93% to SEQ ID NO:2. In embodiments, the nucleic acid sequence has a sequence identity of at least 94% to SEQ ID NO:2. In embodiments, the nucleic acid sequence has a sequence identity of at least 95% to SEQ ID NO:2. In embodiments, the nucleic acid sequence has a sequence identity of at least 96% to SEQ ID NO:2. In embodiments, the nucleic acid sequence has a sequence identity of at least 97% to SEQ ID NO:2. In embodiments, the nucleic acid sequence has a sequence identity of at least 98% to SEQ ID NO:2. In embodiments, the nucleic acid sequence has a sequence identity of at least 99% to SEQ ID NO:2.

In embodiments, the nucleic acid sequence has a sequence identity of 71% to SEQ ID NO:1. In embodiments, the nucleic acid sequence has a sequence identity of 72% to SEQ ID NO:1. In embodiments, the nucleic acid sequence has a sequence identity of 73% to SEQ ID NO:1. In embodiments, the nucleic acid sequence has a sequence identity of 74% to SEQ ID NO:1. In embodiments, the nucleic acid sequence has a sequence identity of 75% to SEQ ID NO:1. In embodiments, the nucleic acid sequence has a sequence identity of 76% to SEQ ID NO:1. In embodiments, the nucleic acid sequence has a sequence identity of 77% to SEQ ID NO:1. In embodiments, the nucleic acid sequence has a sequence identity of 78% to SEQ ID NO:1. In embodiments, the nucleic acid sequence has a sequence identity of 79% to SEQ ID NO:1. In embodiments, the nucleic acid sequence has a sequence identity of 80% to SEQ ID NO:1.

In embodiments, the nucleic acid sequence has a sequence identity of 81% to SEQ ID NO:1. In embodiments, the nucleic acid sequence has a sequence identity of 82% to SEQ ID NO:1. In embodiments, the nucleic acid sequence has a sequence identity of 83% to SEQ ID NO:1. In embodiments, the nucleic acid sequence has a sequence identity of 84% to SEQ ID NO:1. In embodiments, the nucleic acid sequence has a sequence identity of 85% to SEQ ID NO:1. In embodiments, the nucleic acid sequence has a sequence identity of 86% to SEQ ID NO:1. In embodiments, the nucleic acid sequence has a sequence identity of 87% to SEQ ID NO:1. In embodiments, the nucleic acid sequence has a sequence identity of 88% to SEQ ID NO:1. In embodiments, the nucleic acid sequence has a sequence identity of 89% to SEQ ID NO:1. In embodiments, the nucleic acid sequence has a sequence identity of 90% to SEQ ID NO:1.

In embodiments, the nucleic acid sequence has a sequence identity of 91% to SEQ ID NO:1. In embodiments, the nucleic acid sequence has a sequence identity of 92% to SEQ ID NO:1. In embodiments, the nucleic acid sequence has a sequence identity of 93% to SEQ ID NO:1. In embodiments, the nucleic acid sequence has a sequence identity of 94% to SEQ ID NO:1. In embodiments, the nucleic acid sequence has a sequence identity of 95% to SEQ ID NO:1. In embodiments, the nucleic acid sequence has a sequence identity of 96% to SEQ ID NO:1. In embodiments, the nucleic acid sequence has a sequence identity of 97% to SEQ ID NO:1. In embodiments, the nucleic acid sequence has a sequence identity of 98% to SEQ ID NO:1. In embodiments, the nucleic acid sequence has a sequence identity of 99% to SEQ ID NO:1. In embodiments, the nucleic acid sequence is the sequence of SEQ ID NO:1.

In embodiments, the nucleic acid sequence has a sequence identity of 71% to SEQ ID NO:2. In embodiments, the nucleic acid sequence has a sequence identity of 72% to SEQ ID NO:2. In embodiments, the nucleic acid sequence has a sequence identity of 73% to SEQ ID NO:2. In embodiments, the nucleic acid sequence has a sequence identity of 74% to SEQ ID NO:2. In embodiments, the nucleic acid sequence has a sequence identity of 75% to SEQ ID NO:2. In embodiments, the nucleic acid sequence has a sequence identity of 76% to SEQ ID NO:2. In embodiments, the nucleic acid sequence has a sequence identity of 77% to SEQ ID NO:2. In embodiments, the nucleic acid sequence has a sequence identity of 78% to SEQ ID NO:2. In embodiments, the nucleic acid sequence has a sequence identity of 79% to SEQ ID NO:2. In embodiments, the nucleic acid sequence has a sequence identity of 80% to SEQ ID NO:2.

In embodiments, the nucleic acid sequence has a sequence identity of 81% to SEQ ID NO:2. In embodiments, the nucleic acid sequence has a sequence identity of 82% to SEQ ID NO:2. In embodiments, the nucleic acid sequence has a sequence identity of 83% to SEQ ID NO:2. In embodiments, the nucleic acid sequence has a sequence identity of 84% to SEQ ID NO:2. In embodiments, the nucleic acid sequence has a sequence identity of 85% to SEQ ID NO:2. In embodiments, the nucleic acid sequence has a sequence identity of 86% to SEQ ID NO:2. In embodiments, the nucleic acid sequence has a sequence identity of 87% to SEQ ID NO:2. In embodiments, the nucleic acid sequence has a sequence identity of 88% to SEQ ID NO:2. In embodiments, the nucleic acid sequence has a sequence identity of 89% to SEQ ID NO:2. In embodiments, the nucleic acid sequence has a sequence identity of 90% to SEQ ID NO:2.

In embodiments, the nucleic acid sequence has a sequence identity of 91% to SEQ ID NO:2. In embodiments, the nucleic acid sequence has a sequence identity of 92% to SEQ ID NO:2. In embodiments, the nucleic acid sequence has a sequence identity of 93% to SEQ ID NO:2. In embodiments, the nucleic acid sequence has a sequence identity of 94% to SEQ ID NO:2. In embodiments, the nucleic acid sequence has a sequence identity of 95% to SEQ ID NO:2. In embodiments, the nucleic acid sequence has a sequence identity of 96% to SEQ ID NO:2. In embodiments, the nucleic acid sequence has a sequence identity of 97% to SEQ ID NO:2. In embodiments, the nucleic acid sequence has a sequence identity of 98% to SEQ ID NO:2. In embodiments, the nucleic acid sequence has a sequence identity of 99% to SEQ ID NO:2. In embodiments, the nucleic acid sequence is the sequence of SEQ ID NO:1.

In embodiments, the nucleic acid sequence has a sequence identity of about 71% to SEQ ID NO:1. In embodiments, the nucleic acid sequence has a sequence identity of about 72% to SEQ ID NO:1. In embodiments, the nucleic acid sequence has a sequence identity of about 73% to SEQ ID NO:1. In embodiments, the nucleic acid sequence has a sequence identity of about 74% to SEQ ID NO:1. In embodiments, the nucleic acid sequence has a sequence identity of about 75% to SEQ ID NO:1. In embodiments, the nucleic acid sequence has a sequence identity of about 76% to SEQ ID NO:1. In embodiments, the nucleic acid sequence has a sequence identity of about 77% to SEQ ID NO:1. In embodiments, the nucleic acid sequence has a sequence identity of about 78% to SEQ ID NO:1. In embodiments, the nucleic acid sequence has a sequence identity of about 79% to SEQ ID NO:1. In embodiments, the nucleic acid sequence has a sequence identity of about 80% to SEQ ID NO:1.

In embodiments, the nucleic acid sequence has a sequence identity of about 81% to SEQ ID NO:1. In embodiments, the nucleic acid sequence has a sequence identity of about 82% to SEQ ID NO:1. In embodiments, the nucleic acid sequence has a sequence identity of about 83% to SEQ ID NO:1. In embodiments, the nucleic acid sequence has a sequence identity of about 84% to SEQ ID NO:1. In embodiments, the nucleic acid sequence has a sequence identity of about 85% to SEQ ID NO:1. In embodiments, the nucleic acid sequence has a sequence identity of about 86% to SEQ ID NO:1. In embodiments, the nucleic acid sequence has a sequence identity of about 87% to SEQ ID NO:1. In embodiments, the nucleic acid sequence has a sequence identity of about 88% to SEQ ID NO:1. In embodiments, the nucleic acid sequence has a sequence identity of about 89% to SEQ ID NO:1. In embodiments, the nucleic acid sequence has a sequence identity of about 90% to SEQ ID NO:1.

In embodiments, the nucleic acid sequence has a sequence identity of about 91% to SEQ ID NO:1. In embodiments, the nucleic acid sequence has a sequence identity of about 92% to SEQ ID NO:1. In embodiments, the nucleic acid sequence has a sequence identity of about 93% to SEQ ID NO:1. In embodiments, the nucleic acid sequence has a sequence identity of about 94% to SEQ ID NO:1. In embodiments, the nucleic acid sequence has a sequence identity of about 95% to SEQ ID NO:1. In embodiments, the nucleic acid sequence has a sequence identity of about 96% to SEQ ID NO:1. In embodiments, the nucleic acid sequence has a sequence identity of about 97% to SEQ ID NO:1. In embodiments, the nucleic acid sequence has a sequence identity of about 98% to SEQ ID NO:1. In embodiments, the nucleic acid sequence has a sequence identity of about 99% to SEQ ID NO:1.

In embodiments, the nucleic acid sequence has a sequence identity of about 71% to SEQ ID NO:2. In embodiments, the nucleic acid sequence has a sequence identity of about 72% to SEQ ID NO:2. In embodiments, the nucleic acid sequence has a sequence identity of about 73% to SEQ ID NO:2. In embodiments, the nucleic acid sequence has a sequence identity of about 74% to SEQ ID NO:2. In embodiments, the nucleic acid sequence has a sequence identity of about 75% to SEQ ID NO:2. In embodiments, the nucleic acid sequence has a sequence identity of about 76% to SEQ ID NO:2. In embodiments, the nucleic acid sequence has a sequence identity of about 77% to SEQ ID NO:2. In embodiments, the nucleic acid sequence has a sequence identity of about 78% to SEQ ID NO:2. In embodiments, the nucleic acid sequence has a sequence identity of about 79% to SEQ ID NO:2. In embodiments, the nucleic acid sequence has a sequence identity of about 80% to SEQ ID NO:2.

In embodiments, the nucleic acid sequence has a sequence identity of about 81% to SEQ ID NO:2. In embodiments, the nucleic acid sequence has a sequence identity of about 82% to SEQ ID NO:2. In embodiments, the nucleic acid sequence has a sequence identity of about 83% to SEQ ID NO:2. In embodiments, the nucleic acid sequence has a sequence identity of about 84% to SEQ ID NO:2. In embodiments, the nucleic acid sequence has a sequence identity of about 85% to SEQ ID NO:2. In embodiments, the nucleic acid sequence has a sequence identity of about 86% to SEQ ID NO:2. In embodiments, the nucleic acid sequence has a sequence identity of about 87% to SEQ ID NO:2. In embodiments, the nucleic acid sequence has a sequence identity of about 88% to SEQ ID NO:2. In embodiments, the nucleic acid sequence has a sequence identity of about 89% to SEQ ID NO:2. In embodiments, the nucleic acid sequence has a sequence identity of about 90% to SEQ ID NO:2.

In embodiments, the nucleic acid sequence has a sequence identity of about 91% to SEQ ID NO:2. In embodiments, the nucleic acid sequence has a sequence identity of about 92% to SEQ ID NO:2. In embodiments, the nucleic acid sequence has a sequence identity of about 93% to SEQ ID NO:2. In embodiments, the nucleic acid sequence has a sequence identity of about 94% to SEQ ID NO:2. In embodiments, the nucleic acid sequence has a sequence identity of about 95% to SEQ ID NO:2. In embodiments, the nucleic acid sequence has a sequence identity of about 96% to SEQ ID NO:2. In embodiments, the nucleic acid sequence has a sequence identity of about 97% to SEQ ID NO:2. In embodiments, the nucleic acid sequence has a sequence identity of about 98% to SEQ ID NO:2. In embodiments, the nucleic acid sequence has a sequence identity of about 99% to SEQ ID NO:2.

The nucleic acid sequence may have a sequence identity of at least 70%, and the nucleic acid sequence having at least 70% sequence identity may be contiguous. In embodiments, the nucleic acid sequence has a sequence identity of at least 70%, and the nucleic acid sequence having at least 70% sequence identity is a non-contiguous sequence. A "non-contiguous sequence" as provided herein refers to a sequence including one or more sequence fragments having no sequence identity to SEQ ID NO:1 or SEQ ID NO:2. In embodiments, the non-contiguous sequence is a sequence including a first sequence fragment having at least 70% sequence identity to SEQ ID NO:1 or SEQ ID NO:2 connected to a second sequence fragment having at least 70% sequence identity to SEQ ID NO:1 or SEQ ID NO:2 through a sequence fragment having no sequence identity to SEQ ID NO:1 or SEQ ID NO:2. In embodiments, the non-contiguous sequence is a sequence including a plurality of sequence fragments having at least 70% sequence identity to SEQ ID NO:1 or SEQ ID NO:2 connected through a plurality of sequence fragments having no sequence identity to SEQ ID NO:1 or SEQ ID NO:2. In embodiments, the chimeric poxvirus further includes a nucleotide insertion, deletion or mutation.

In embodiments, the nucleic acid fragments are from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic and vaccinia virus strain AS.

In embodiments, the nucleic acid sequence includes nucleic acid fragments from cowpox virus strain Brighton and raccoonpox virus strain Herman. In embodiments, the nucleic acid sequence includes nucleic acid fragments from cowpox virus strain Brighton and rabbitpox virus strain Utrecht. In embodiments, the nucleic acid sequence includes nucleic acid fragments from cowpox virus strain Brighton and vaccinia virus strain WR. In embodiments, the nucleic acid sequence includes nucleic acid fragments from cowpox virus strain Brighton and vaccinia virus strain IHD. In embodiments, the nucleic acid sequence includes nucleic acid fragments from cowpox virus strain Brighton and vaccinia virus strain Elstree. In embodiments, the nucleic acid sequence includes nucleic acid fragments from cowpox virus strain Brighton and vaccinia virus strain CL. In embodiments, the nucleic acid sequence includes nucleic acid fragments from cowpox virus strain Brighton and vaccinia virus strain Lederle-Chorioallantoic. In embodiments, the nucleic acid sequence includes nucleic acid fragments from cowpox virus strain Brighton and vaccinia virus strain AS. In embodiments, the nucleic acid sequence includes nucleic acid fragments from cowpox virus strain Brighton and orf virus strain NZ2. In embodiments, the nucleic acid sequence includes nucleic acid fragments from cowpox virus strain Brighton and pseudocowpox virus strain TJS.

In embodiments, the nucleic acid sequence includes nucleic acid fragments from rabbitpox virus strain Utrecht and vaccinia virus strain WR. In embodiments, the nucleic acid sequence includes nucleic acid fragments from rabbitpox virus strain Utrecht and vaccinia virus strain IHD. In embodiments, the nucleic acid sequence includes nucleic acid fragments from rabbitpox virus strain Utrecht and vaccinia virus strain Elstree. In embodiments, the nucleic acid sequence includes nucleic acid fragments from rabbitpox virus strain Utrecht and vaccinia virus strain CL. In embodiments, the nucleic acid sequence includes nucleic acid fragments from rabbitpox virus strain Utrecht and vaccinia virus strain Lederle-Chorioallantoic. In embodiments, the nucleic acid sequence includes nucleic acid fragments from rabbitpox virus strain Utrecht and vaccinia virus strain AS. In embodiments, the nucleic acid sequence includes nucleic acid fragments from rabbitpox virus strain Utrecht and orf virus strain NZ2. In embodiments, the nucleic acid sequence includes nucleic acid fragments from rabbitpox virus strain Utrecht and pseudocowpox virus strain TJS.

In embodiments, the nucleic acid sequence includes nucleic acid fragments from vaccinia virus strain WR and vaccinia virus strain IHD. In embodiments, the nucleic acid sequence includes nucleic acid fragments from vaccinia virus strain WR and vaccinia virus strain Elstree. In embodiments, the nucleic acid sequence includes nucleic acid fragments from vaccinia virus strain WR and vaccinia virus strain CL. In embodiments, the nucleic acid sequence includes nucleic acid fragments from vaccinia virus strain WR and vaccinia virus strain Lederle-Chorioallantoic. In embodiments, the nucleic acid sequence includes nucleic acid fragments from vaccinia virus strain WR and vaccinia virus strain AS. In embodiments, the nucleic acid sequence includes nucleic acid fragments from vaccinia virus strain WR and orf virus strain NZ2. In embodiments, the nucleic acid sequence includes nucleic acid fragments from vaccinia virus strain WR and pseudocowpox virus strain TJS.

In embodiments, the nucleic acid sequence includes nucleic acid fragments from vaccinia virus strain IHD and vaccinia virus strain Elstree. In embodiments, the nucleic acid sequence includes nucleic acid fragments from vaccinia virus strain IHD and vaccinia virus strain CL. In embodiments, the nucleic acid sequence includes nucleic acid fragments from vaccinia virus strain IHD and vaccinia virus strain Lederle-Chorioallantoic. In embodiments, the nucleic acid sequence includes nucleic acid fragments from vaccinia virus strain IHD and vaccinia virus strain AS. In embodiments, the nucleic acid sequence includes nucleic acid fragments from vaccinia virus strain IHD and orf virus strain NZ2. In embodiments, the nucleic acid sequence includes nucleic acid fragments from vaccinia virus strain IHD and pseudocowpox virus strain TJS.

In embodiments, the nucleic acid sequence includes nucleic acid fragments from vaccinia virus strain Elstree and vaccinia virus strain CL. In embodiments, the nucleic acid sequence includes nucleic acid fragments from vaccinia virus strain Elstree and vaccinia virus strain Lederle-Chorioallantoic. In embodiments, the nucleic acid sequence includes nucleic acid fragments from vaccinia virus strain Elstree and vaccinia virus strain AS. In embodiments, the nucleic acid sequence includes nucleic acid fragments from vaccinia virus strain Elstree and orf virus strain NZ2. In embodiments, the nucleic acid sequence includes nucleic acid fragments from vaccinia virus strain Elstree and pseudocowpox virus strain TJS.

In embodiments, the nucleic acid sequence includes nucleic acid fragments from vaccinia virus strain CL and vaccinia virus strain Lederle-Chorioallantoic. In embodiments, the nucleic acid sequence includes nucleic acid fragments from vaccinia virus strain CL and vaccinia virus strain AS. In embodiments, the nucleic acid sequence includes nucleic acid fragments from vaccinia virus strain CL and orf virus strain NZ2. In embodiments, the nucleic acid sequence includes nucleic acid fragments from vaccinia virus strain CL and pseudocowpox virus strain TJS.

In embodiments, the nucleic acid sequence includes nucleic acid fragments from vaccinia virus strain Lederle-Chorioallantoic and vaccinia virus strain AS. In embodiments, the nucleic acid sequence includes nucleic acid fragments from vaccinia virus strain Lederle-Chorioallantoic and orf virus strain NZ2. In embodiments, the nucleic acid sequence includes nucleic acid fragments from vaccinia virus strain Lederle-Chorioallantoic and pseudocowpox virus strain TJS.

In embodiments, the nucleic acid sequence includes nucleic acid fragments from vaccinia virus strain AS and orf virus strain NZ2. In embodiments, the nucleic acid sequence includes nucleic acid fragments from vaccinia virus strain AS and pseudocowpox virus strain TJS. In embodiments, the nucleic acid sequence includes nucleic acid fragments from orf virus strain NZ2 and pseudocowpox virus strain TJS.

In embodiments, the chimeric poxvirus includes a nucleic acid sequence having a sequence identity of at least 70% to SEQ ID NO:1 and wherein the nucleic acid sequence includes nucleic acid fragments from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic or vaccinia virus strain AS. In embodiments, the chimeric poxvirus includes a nucleic acid sequence having a sequence identity of at least 70% to SEQ ID NO:1 and wherein the nucleic acid sequence includes nucleic acid fragments from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic and vaccinia virus strain AS.

In embodiments, the chimeric poxvirus includes a nucleic acid sequence having a sequence identity of at least 70% to SEQ ID NO:1 and wherein the nucleic acid sequence includes nucleic acid fragments from cowpox virus strain Brighton. In embodiments, the chimeric poxvirus includes a nucleic acid sequence having a sequence identity of at least 70% to SEQ ID NO:1 and wherein the nucleic acid sequence includes nucleic acid fragments from raccoonpox virus strain Herman. In embodiments, the chimeric poxvirus includes a nucleic acid sequence having a sequence identity of at least 70% to SEQ ID NO:1 and wherein the nucleic acid sequence includes nucleic acid fragments from rabbitpox virus strain Utrecht. In embodiments, the chimeric poxvirus includes a nucleic acid sequence having a sequence identity of at least 70% to SEQ ID NO:1 and wherein the nucleic acid sequence includes nucleic acid fragments from vaccinia virus strain WR. In embodiments, the chimeric poxvirus includes a nucleic acid sequence having a sequence identity of at least 70% to SEQ ID NO:1 and wherein the nucleic acid sequence includes nucleic acid fragments from vaccinia virus strain IHD. In embodiments, the chimeric poxvirus includes a nucleic acid sequence having a sequence identity of at least 70% to SEQ ID NO:1 and wherein the nucleic acid sequence includes nucleic acid fragments from vaccinia virus strain Elstree. In embodiments, the chimeric poxvirus includes a nucleic acid sequence having a sequence identity of at least 70% to SEQ ID NO:1 and wherein the nucleic acid sequence includes nucleic acid fragments from vaccinia virus strain CL. In embodiments, the chimeric poxvirus includes a nucleic acid sequence having a sequence identity of at least 70% to SEQ ID NO:1 and wherein the nucleic acid sequence includes nucleic acid fragments from vaccinia virus strain Lederle-Chorioallantoic or vaccinia virus strain AS.

In embodiments, the chimeric poxvirus includes a nucleic acid sequence having a sequence identity of at least 70% to SEQ ID NO:2 and wherein the nucleic acid sequence includes nucleic acid fragments from orf virus strain NZ2 and pseudocowpox virus strain TJS. In embodiments, the chimeric poxvirus includes a nucleic acid sequence having a sequence identity of at least 70% to SEQ ID NO:2 and wherein the nucleic acid sequence includes nucleic acid fragments from orf virus strain NZ2. In embodiments, the chimeric poxvirus includes a nucleic acid sequence having a sequence identity of at least 70% to SEQ ID NO:2 and wherein the nucleic acid sequence includes nucleic acid fragments from pseudocowpox virus strain TJS.

In embodiments, the chimeric poxvirus includes a nucleic acid sequence having a sequence identity of at least 80% to SEQ ID NO:1 and wherein the nucleic acid sequence includes nucleic acid fragments from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic or vaccinia virus strain AS. In embodiments, the chimeric poxvirus includes a nucleic acid sequence having a sequence identity of at least 80% to SEQ ID NO:1 and wherein the nucleic acid sequence includes nucleic acid fragments from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic and vaccinia virus strain AS.

In embodiments, the chimeric poxvirus includes a nucleic acid sequence having a sequence identity of at least 80% to SEQ ID NO:1 and wherein the nucleic acid sequence includes nucleic acid fragments from cowpox virus strain Brighton. In embodiments, the chimeric poxvirus includes a nucleic acid sequence having a sequence identity of at least 80% to SEQ ID NO:1 and wherein the nucleic acid sequence includes nucleic acid fragments from raccoonpox virus strain Herman. In embodiments, the chimeric poxvirus includes a nucleic acid sequence having a sequence identity of at least 80% to SEQ ID NO:1 and wherein the nucleic acid sequence includes nucleic acid fragments from rabbitpox virus strain Utrecht. In embodiments, the chimeric poxvirus includes a nucleic acid sequence having a sequence identity of at least 80% to SEQ ID NO:1 and wherein the nucleic acid sequence includes nucleic acid fragments from vaccinia virus strain WR. In embodiments, the chimeric poxvirus includes a nucleic acid sequence having a sequence identity of at least 80% to SEQ ID NO:1 and wherein the nucleic acid sequence includes nucleic acid fragments from vaccinia virus strain IHD. In embodiments, the chimeric poxvirus includes a nucleic acid sequence having a sequence identity of at least 80% to SEQ ID NO:1 and wherein the nucleic acid sequence includes nucleic acid fragments from vaccinia virus strain Elstree. In embodiments, the chimeric poxvirus includes a nucleic acid sequence having a sequence identity of at least 80% to SEQ ID NO:1 and wherein the nucleic acid sequence includes nucleic acid fragments from vaccinia virus strain CL. In embodiments, the chimeric poxvirus includes a nucleic acid sequence having a sequence identity of at least 80% to SEQ ID NO:1 and wherein the nucleic acid sequence includes nucleic acid fragments from vaccinia virus strain Lederle-Chorioallantoic or vaccinia virus strain AS.

In embodiments, the chimeric poxvirus includes a nucleic acid sequence having a sequence identity of at least 80% to SEQ ID NO:2 and wherein the nucleic acid sequence includes nucleic acid fragments from orf virus strain NZ2 and pseudocowpox virus strain TJS. In embodiments, the chimeric poxvirus includes a nucleic acid sequence having a sequence identity of at least 80% to SEQ ID NO:2 and wherein the nucleic acid sequence includes nucleic acid fragments from orf virus strain NZ2. In embodiments, the chimeric poxvirus includes a nucleic acid sequence having a sequence identity of at least 80% to SEQ ID NO:2 and wherein the nucleic acid sequence includes nucleic acid fragments from pseudocowpox virus strain TJS.

In embodiments, the chimeric poxvirus includes a nucleic acid sequence having a sequence identity of at least 90% to SEQ ID NO:1 and wherein the nucleic acid sequence includes nucleic acid fragments from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic or vaccinia virus strain AS. In embodiments, the chimeric poxvirus includes a nucleic acid sequence having a sequence identity of at least 90% to SEQ ID NO:1 and wherein the nucleic acid sequence includes nucleic acid fragments from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic and vaccinia virus strain AS.

In embodiments, the chimeric poxvirus includes a nucleic acid sequence having a sequence identity of at least 90% to SEQ ID NO:1 and wherein the nucleic acid sequence includes nucleic acid fragments from cowpox virus strain Brighton. In embodiments, the chimeric poxvirus includes a nucleic acid sequence having a sequence identity of at least 90% to SEQ ID NO:1 and wherein the nucleic acid sequence includes nucleic acid fragments from raccoonpox virus strain Herman. In embodiments, the chimeric poxvirus includes a nucleic acid sequence having a sequence identity of at least 90% to SEQ ID NO:1 and wherein the nucleic acid sequence includes nucleic acid fragments from rabbitpox virus strain Utrecht. In embodiments, the chimeric poxvirus includes a nucleic acid sequence having a sequence identity of at least 90% to SEQ ID NO:1 and wherein the nucleic acid sequence includes nucleic acid fragments from vaccinia virus strain WR. In embodiments, the chimeric poxvirus includes a nucleic acid sequence having a sequence identity of at least 90% to SEQ ID NO:1 and wherein the nucleic acid sequence includes nucleic acid fragments from vaccinia virus strain IHD. In embodiments, the chimeric poxvirus includes a nucleic acid sequence having a sequence identity of at least 90% to SEQ ID NO:1 and wherein the nucleic acid sequence includes nucleic acid fragments from vaccinia virus strain Elstree. In embodiments, the chimeric poxvirus includes a nucleic acid sequence having a sequence identity of at least 90% to SEQ ID NO:1 and wherein the nucleic acid sequence includes nucleic acid fragments from vaccinia virus strain CL. In embodiments, the chimeric poxvirus includes a nucleic acid sequence having a sequence identity of at least 90% to SEQ ID NO:1 and wherein the nucleic acid sequence includes nucleic acid fragments from vaccinia virus strain Lederle-Chorioallantoic or vaccinia virus strain AS.

In embodiments, the chimeric poxvirus includes a nucleic acid sequence having a sequence identity of at least 90% to SEQ ID NO:2 and wherein the nucleic acid sequence includes nucleic acid fragments from orf virus strain NZ2 and pseudocowpox virus strain TJS. In embodiments, the chimeric poxvirus includes a nucleic acid sequence having a sequence identity of at least 90% to SEQ ID NO:2 and wherein the nucleic acid sequence includes nucleic acid fragments from orf virus strain NZ2. In embodiments, the chimeric poxvirus includes a nucleic acid sequence having a sequence identity of at least 90% to SEQ ID NO:2 and wherein the nucleic acid sequence includes nucleic acid fragments from pseudocowpox virus strain TJS.

In embodiments, the chimeric poxvirus includes a nucleic acid sequence having a sequence identity of at least 95% to SEQ ID NO:1 and wherein the nucleic acid sequence includes nucleic acid fragments from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic or vaccinia virus strain AS. In embodiments, the chimeric poxvirus includes a nucleic acid sequence having a sequence identity of at least 95% to SEQ ID NO:1 and wherein the nucleic acid sequence includes nucleic acid fragments from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic and vaccinia virus strain AS.

In embodiments, the chimeric poxvirus includes a nucleic acid sequence having a sequence identity of at least 95% to SEQ ID NO:1 and wherein the nucleic acid sequence includes nucleic acid fragments from cowpox virus strain Brighton. In embodiments, the chimeric poxvirus includes a nucleic acid sequence having a sequence identity of at least 95% to SEQ ID NO:1 and wherein the nucleic acid sequence includes nucleic acid fragments from raccoonpox virus strain Herman. In embodiments, the chimeric poxvirus includes a nucleic acid sequence having a sequence identity of at least 95% to SEQ ID NO:1 and wherein the nucleic acid sequence includes nucleic acid fragments from rabbitpox virus strain Utrecht. In embodiments, the chimeric poxvirus includes a nucleic acid sequence having a sequence identity of at least 95% to SEQ ID NO:1 and wherein the nucleic acid sequence includes nucleic acid fragments from vaccinia virus strain WR. In embodiments, the chimeric poxvirus includes a nucleic acid sequence having a sequence identity of at least 95% to SEQ ID NO:1 and wherein the nucleic acid sequence includes nucleic acid fragments from vaccinia virus strain IHD. In embodiments, the chimeric poxvirus includes a nucleic acid sequence having a sequence identity of at least 95% to SEQ ID NO:1 and wherein the nucleic acid sequence includes nucleic acid fragments from vaccinia virus strain Elstree. In embodiments, the chimeric poxvirus includes a nucleic acid sequence having a sequence identity of at least 95% to SEQ ID NO:1 and wherein the nucleic acid sequence includes nucleic acid fragments from vaccinia virus strain CL. In embodiments, the chimeric poxvirus includes a nucleic acid sequence having a sequence identity of at least 95% to SEQ ID NO:1 and wherein the nucleic acid sequence includes nucleic acid fragments from vaccinia virus strain Lederle-Chorioallantoic or vaccinia virus strain AS.

In embodiments, the chimeric poxvirus includes a nucleic acid sequence having a sequence identity of at least 95% to SEQ ID NO:2 and wherein the nucleic acid sequence includes nucleic acid fragments from orf virus strain NZ2 and pseudocowpox virus strain TJS. In embodiments, the chimeric poxvirus includes a nucleic acid sequence having a sequence identity of at least 95% to SEQ ID NO:2 and wherein the nucleic acid sequence includes nucleic acid fragments from orf virus strain NZ2. In embodiments, the chimeric poxvirus includes a nucleic acid sequence having a sequence identity of at least 95% to SEQ ID NO:2 and wherein the nucleic acid sequence includes nucleic acid fragments from pseudocowpox virus strain TJS.

In embodiments, the chimeric poxvirus includes a nucleic acid sequence having a sequence identity of at least 98% to SEQ ID NO:1 and wherein the nucleic acid sequence includes nucleic acid fragments from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic or vaccinia virus strain AS. In embodiments, the chimeric poxvirus includes a nucleic acid sequence having a sequence identity of at least 98% to SEQ ID NO:1 and wherein the nucleic acid sequence includes nucleic acid fragments from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic and vaccinia virus strain AS.

In embodiments, the chimeric poxvirus includes a nucleic acid sequence having a sequence identity of at least 98% to SEQ ID NO:1 and wherein the nucleic acid sequence includes nucleic acid fragments from cowpox virus strain Brighton. In embodiments, the chimeric poxvirus includes a nucleic acid sequence having a sequence identity of at least 98% to SEQ ID NO:1 and wherein the nucleic acid sequence includes nucleic acid fragments from raccoonpox virus strain Herman. In embodiments, the chimeric poxvirus includes a nucleic acid sequence having a sequence identity of at least 98% to SEQ ID NO:1 and wherein the nucleic acid sequence includes nucleic acid fragments from rabbitpox virus strain Utrecht. In embodiments, the chimeric poxvirus includes a nucleic acid sequence having a sequence identity of at least 98% to SEQ ID NO:1 and wherein the nucleic acid sequence includes nucleic acid fragments from vaccinia virus strain WR. In embodiments, the chimeric poxvirus includes a nucleic acid sequence having a sequence identity of at least 98% to SEQ ID NO:1 and wherein the nucleic acid sequence includes nucleic acid fragments from vaccinia virus strain IHD. In embodiments, the chimeric poxvirus includes a nucleic acid sequence having a sequence identity of at least 98% to SEQ ID NO:1 and wherein the nucleic acid sequence includes nucleic acid fragments from vaccinia virus strain Elstree. In embodiments, the chimeric poxvirus includes a nucleic acid sequence having a sequence identity of at least 98% to SEQ ID NO:1 and wherein the nucleic acid sequence includes nucleic acid fragments from vaccinia virus strain CL. In embodiments, the chimeric poxvirus includes a nucleic acid sequence having a sequence identity of at least 98% to SEQ ID NO:1 and wherein the nucleic acid sequence includes nucleic acid fragments from vaccinia virus strain Lederle-Chorioallantoic or vaccinia virus strain AS.

In embodiments, the chimeric poxvirus includes a nucleic acid sequence having a sequence identity of at least 98% to SEQ ID NO:2 and wherein the nucleic acid sequence includes nucleic acid fragments from orf virus strain NZ2 and pseudocowpox virus strain TJS. In embodiments, the chimeric poxvirus includes a nucleic acid sequence having a sequence identity of at least 98% to SEQ ID NO:2 and wherein the nucleic acid sequence includes nucleic acid fragments from orf virus strain NZ2. In embodiments, the chimeric poxvirus includes a nucleic acid sequence having a sequence identity of at least 98% to SEQ ID NO:2 and wherein the nucleic acid sequence includes nucleic acid fragments from pseudocowpox virus strain TJS.

In embodiments, the chimeric poxvirus is an oncolytic virus. An oncolytic virus, as used herein is a virus capable of targeting and eliminating cancer cells. In embodiments, the oncolytic virus targets lung cancer cells. In embodiments, the oncolytic virus targets ovarian cancer cells. In embodiments, the oncolytic virus targets pancreatic cancer cells. In embodiments, the oncolytic virus preferentially targets cancer cells relative to non-cancer cells.

In embodiments, the miRNA binding sequence forms part of the DNA polymerase gene of the chimeric poxvirus. In embodiments, the poxvirus includes a miRNA binding sequence. In embodiments, the poxvirus includes a plurality of miRNA binding sequences. In embodiments, the plurality of miRNA binding sequences are independently different. In embodiments, the plurality of miRNA binding sequences are the same. In embodiments, the miRNA binding sequence is about 22 nucleotides in length. In embodiments, the miRNA binding sequence is at least 22 nucleotides in length. In embodiments, the miRNA binding sequence is 22 nucleotides in length. In embodiments, the miRNA binding sequence is about 22 nucleotides in length. In embodiments, each of the plurality of miRNA binding sequences is at least 22 nucleotides in length. In embodiments, each of the plurality of miRNA binding sequences is about 22 nucleotides in length. In embodiments, each of the plurality of miRNA binding sequences is 22 nucleotides in length.

In an aspect, provided is an isolated nucleic acid encoding a chimeric poxvirus as described herein. In embodiments, the isolated nucleic acid is SEQ ID NO:1. In embodiments, the isolated nucleic acid is SEQ ID NO:2.

III. Viral Compositions Including Transgenes

The chimeric poxviruses provided herein including embodiments thereof may include transgenes. The transgenes included in the chimeric poxvirus provided herein may increase the oncolytic activity of the chimeric poxvirus compared to a chimeric poxvirus lacking said transgene. The transgenes may further increase the capability of the chimeric poxvirus to differentially express/replicate in cancer cells relative to healthy (non-cancer) cells. Where the chimeric poxvirus includes transgenes, the nucleic acid of the chimeric poxvirus includes an anti-cancer nucleic acid sequence, a nucleic acid binding sequence, a detectable moiety-encoding nucleic acid sequence or any combination thereof. Thus, in an aspect is provided a chimeric poxvirus including a nucleic acid sequence having a sequence identity of at least 70% to SEQ ID NO:1 or SEQ ID NO:2, wherein the nucleic acid sequence includes: (i) nucleic acid fragments from at least two poxvirus strains selected from the group consisting of cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS; (ii) one or more anti-cancer nucleic acid sequences; or (iii) a detectable moiety-encoding nucleic acid sequence.

In an aspect is provided a chimeric poxvirus including a nucleic acid sequence having a sequence identity of at least 70% to SEQ ID NO:1, wherein the nucleic acid sequence includes: (i) nucleic acid fragments from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, and vaccinia virus strain AS; (ii) one or more anti-cancer nucleic acid sequences; or (iii) a detectable moiety-encoding nucleic acid sequence.

In an aspect is provided a chimeric poxvirus including a nucleic acid sequence having a sequence identity of at least 70% to SEQ ID NO:2, wherein the nucleic acid sequence includes: (i) nucleic acid fragments from orf virus strain NZ2 and pseudocowpox virus strain TJS; (ii) one or more anti-cancer nucleic acid sequences; or (iii) a detectable moiety-encoding nucleic acid sequence.

In an aspect is provided a chimeric poxvirus including a nucleic acid sequence having a sequence identity of at least 70% to SEQ ID NO:3, wherein the nucleic acid sequence includes: (i) nucleic acid fragments from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, and vaccinia virus strain AS; (ii) one or more anti-cancer nucleic acid sequences; or (iii) a detectable moiety-encoding nucleic acid sequence.

As used herein, the terms "anti-cancer nucleic acid sequence" or "anti-cancer nucleic acid sequences" refer to nucleic acid sequences having antineoplastic properties and/or the ability to inhibit the growth or proliferation of a cancer cell and/or provide for selective expression of the chimeric poxvirus provided herein including embodiments thereof in a cancer cell relative to a healthy cell. Anti-cancer nucleic acid sequences may inhibit the progression or slow the progression of cancer temporarily or permanently. Examples of anti-cancer nucleic acid sequences include sequences encoding proteins the expression of which directly or indirectly inhibits cancer cell growth. For example, an anti-cancer nucleic acid sequence as provided herein may encode a protein, which is expressed at a higher level in a cancer cell relative to a healthy cell (e.g., sodium iodide transporter)). In another non-limiting example, an anti-cancer nucleic acid sequence may encode a polypeptide (antibody) capable of de-repressing anti-tumor immune responses (e.g., anti-PD-L1 antibodies or fragments thereof). In embodiments, the anti-cancer nucleic acid sequence includes a nucleic acid sequence capable of increasing expression/replication of a chimeric poxvirus in a cancer cell relative to a healthy cell. Thus, in embodiments, the expression (e.g., transcription, translation) rate of a chimeric poxvirus including the anti-cancer nucleic acid sequence is decreased in a healthy cell relative to a cancer cell. In embodiments, the chimeric poxvirus including the anti-cancer nucleic acid sequence is not expressed at a detectable amount in a healthy cell. In embodiments, the anti-cancer nucleic acid sequence is a nucleic acid binding sequence. In embodiments, the anti-cancer nucleic acid sequence includes a nucleic acid binding sequence.

As used herein, a "nucleic acid binding sequence" refers to a nucleic acid sequence capable of binding (hybridizing) to an at least partially complementary cellular nucleic acid (e.g., DNA, RNA, miRNA), wherein the cellular nucleic acid is present at an increased amount in a healthy cell relative to a cancer cell. The nucleic acid binding sequence provided herein may form part of the nucleic acid comprised by the chimeric poxvirus and may be operably linked to a gene of the chimeric poxvirus. Upon binding of the cellular nucleic acid to the nucleic acid binding sequence the chimeric poxvirus gene may be targeted for degradation (hydrolysis), thereby decreasing expression/replication of the chimeric poxvirus. In embodiments, the nucleic acid binding sequence is a DNA binding sequence. In embodiments, the nucleic acid binding sequence is a RNA binding sequence. In embodiments, the nucleic acid binding sequence is a miRNA binding sequence. Therefore, in embodiments, the anti-cancer nucleic acid sequence is a nucleic acid binding sequence. In embodiments, the anti-cancer nucleic acid sequence is a DNA binding sequence. In embodiments, the anti-cancer nucleic acid sequence is a RNA binding sequence. In embodiments, the anti-cancer nucleic acid sequence is a miRNA binding sequence.

A "detectable moiety-encoding nucleic acid sequence" as used herein refers to a nucleic acid sequence that encodes a composition detectable by spectroscopic, photochemical, biochemical, immunochemical, chemical, or other physical means. Detectable moiety-encoding nucleic acid sequences may encode a fluorescent moiety. Non-limiting examples of fluorescent moieties are mCherry, Emerald, and firefly luciferase.

In an aspect is provided a chimeric poxvirus including a nucleic acid sequence having a sequence identity of at least 70% to SEQ ID NO:1 or SEQ ID NO:2, wherein the nucleic acid sequence includes: (i) nucleic acid fragments from at least two poxvirus strains selected from the group consisting of cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS; (ii) one or more anti-cancer nucleic acid sequences; (iii) one or more nucleic acid binding sequences; or (iv) a detectable moiety-encoding nucleic acid sequence.

In another aspect is provided a chimeric poxvirus including a nucleic acid sequence having a sequence identity of at least 70% to SEQ ID NO:1, wherein the nucleic acid sequence includes: (i) nucleic acid fragments from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, and vaccinia virus strain AS; (ii) one or more anti-cancer nucleic acid sequences; (iii) one or more nucleic acid binding sequences; or (iv) a detectable moiety-encoding nucleic acid sequence.

In another aspect is provided a chimeric poxvirus including a nucleic acid sequence having a sequence identity of at least 70% to SEQ ID NO:2, wherein the nucleic acid sequence includes: (i) nucleic acid fragments from orf virus strain NZ2 and pseudocowpox virus strain TJS; (ii) one or more anti-cancer nucleic acid sequences; (iii) one or more nucleic acid binding sequences; or (iv) a detectable moiety-encoding nucleic acid sequence.

In another aspect is provided a chimeric poxvirus including a nucleic acid sequence having a sequence identity of at least 70% to SEQ ID NO:3, wherein the nucleic acid sequence includes: (i) nucleic acid fragments from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, and vaccinia virus strain AS; (ii) one or more anti-cancer nucleic acid sequences; (iii) one or more nucleic acid binding sequences; or (iv) a detectable moiety-encoding nucleic acid sequence.

In embodiments, the nucleic acid sequence includes: (i) nucleic acid fragments from at least two poxvirus strains selected from the group consisting of cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS; and (ii) one or more anti-cancer nucleic acid sequences. In embodiments, the nucleic acid fragments are from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic and vaccinia virus strain AS. In embodiments, the nucleic acid fragments are from orf virus strain NZ2 and pseudocowpox virus strain TJS.

In embodiments, the nucleic acid sequence includes: (i) nucleic acid fragments from at least two poxvirus strains selected from the group consisting of cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS; and (ii) one or more nucleic acid binding sequences. In embodiments, the nucleic acid fragments are from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic and vaccinia virus strain AS. In embodiments, the nucleic acid fragments are from orf virus strain NZ2 and pseudocowpox virus strain TJS.

In embodiments, the nucleic acid sequence includes: (i) nucleic acid fragments from at least two poxvirus strains selected from the group consisting of cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS; and (ii) a detectable moiety-encoding nucleic acid sequence. In embodiments, the nucleic acid fragments are from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic and vaccinia virus strain AS. In embodiments, the nucleic acid fragments are from orf virus strain NZ2 and pseudocowpox virus strain TJS.

In embodiments, the nucleic acid sequence includes: (i) nucleic acid fragments from at least two poxvirus strains selected from the group consisting of cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS; (ii) one or more anti-cancer nucleic acid sequences; and (iii) a detectable moiety-encoding nucleic acid sequence. In embodiments, the nucleic acid fragments are from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic and vaccinia virus strain AS. In embodiments, the nucleic acid fragments are from orf virus strain NZ2 and pseudocowpox virus strain TJS.

In embodiments, the nucleic acid sequence includes: (i) nucleic acid fragments from at least two poxvirus strains selected from the group consisting of cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS; (ii) one or more anti-cancer nucleic acid sequences; and (iii) one or more nucleic acid binding sequences. In embodiments, the nucleic acid fragments are from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic and vaccinia virus strain AS. In embodiments, the nucleic acid fragments are from orf virus strain NZ2 and pseudocowpox virus strain TJS.

Anti-cancer nucleic acid sequences (transgenes) may form part of the genome of the chimeric poxvirus provided herein including embodiments thereof. The chimeric poxvirus genome contains genes required for poxvirus expression and replication. Genes that are required for chimeric poxvirus expression and replication are referred to herein as "essential genes." Genes that are not required for expression and replication of the chimeric poxvirus are referred to herein as "non-essential genes." Anti-cancer nucleic acid sequences may be incorporated into the chimeric poxvirus genome through insertion into genes or may be operably linked to genes. Upon insertion of the anti-cancer nucleic acid sequence into a chimeric poxvirus gene, the gene (e.g., non-essential gene) or portions thereof may be deleted. In embodiments, the one or more anti-cancer nucleic acid sequences form part of a non-essential gene of the chimeric poxvirus. In embodiments, the one or more anti-cancer nucleic acid sequences are inserted into a non-essential gene of the chimeric poxvirus. In embodiments, the non-essential gene is a thymidine kinase gene. In embodiments, the non-essential gene is a J2R gene. In embodiments, the non-essential gene is a F14.5L gene.

As discussed above, anti-cancer nucleic acid sequences may encode polypeptides useful for the treatment of cancer. In embodiments, the one or more anti-cancer nucleic acid sequences independently encode a PD-L1 inhibitor or a sodium iodide symporter. In embodiments, the PD-L1 inhibitor is an anti-PD-L1 scFv. In embodiments, the anti-PD-L1 scFv includes the sequence of SEQ ID NO:17. In embodiments, the anti-PD-L1 scFv is the sequence of SEQ ID NO:17. In embodiments, the sodium iodide symporter includes the sequence of SEQ ID NO:13. In embodiments, the sodium iodide symporter is the sequence of SEQ ID NO:13.

A "PD-L1" or "PD-L1 protein" as referred to herein includes any of the recombinant or naturally-occurring forms of programmed death ligand 1 (PD-L1) also known as cluster of differentiation 274 (CD 274) or variants or homologs thereof that maintain PD-L1 activity (e.g. within at least 50%, 80%, 90%, 95%, 96%, 97%, 98%, 99% or 100% activity compared to PD-L1). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring PD-L1 protein. In embodiments, the PD-L1 protein is substantially identical to the protein identified by the UniProt reference number Q9NZQ7 or a variant or homolog having substantial identity thereto.

The term "PD-L1 inhibitor" as provided herein refers to a substance (e.g., antibody, antibody fragment, single chain variable fragment [scFv]) capable of detectably lowering expression of or activity level of PD-L1 compared to a control. The inhibited expression or activity of PD-L1 can be 10%, 20%, 30%, 40%, 50%, 60%, 70%, 80%, 90% or less than that in a control. In certain instances, the inhibition is 1.5-fold, 2-fold, 3-fold, 4-fold, 5-fold, 10-fold, or more in comparison to a control. A PD-L1 inhibitor inhibits PD-L1 e.g., by at least in part, partially or totally blocking stimulation, decreasing, preventing, or delaying activation, or inactivating, desensitizing, or down-regulating signal transduction, activity or amount of PD-L1 relative to the absence of the PD-L1 inhibitor.

The terms "sodium iodide symporter", "NIS", or "hNIS" as referred to herein include any of the recombinant or naturally-occurring forms of the sodium iodide symporter or variants or homologs thereof that maintain sodium iodide symporter activity (e.g. within at least 50%, 80%, 90%, 95%, 96%, 97%, 98%, 99% or 100% activity compared to sodium iodide symporter). In some aspects, the variants or homologs have at least 90%, 95%, 96%, 97%, 98%, 99% or 100% amino acid sequence identity across the whole sequence or a portion of the sequence (e.g. a 50, 100, 150 or 200 continuous amino acid portion) compared to a naturally occurring sodium iodide symporter. In embodiments, the sodium iodide symporter is substantially identical to the protein identified by the UniProt reference number Q92911 or a variant or homolog having substantial identity thereto. In embodiments, the sodium iodide symporter includes the sequence of SEQ ID NO:13. In embodiments, the sodium iodide symporter is the sequence of SEQ ID NO:13.

Expression of the anti-cancer nucleic acid sequence provided herein may be controlled by a promoter. Therefore, in embodiments, the one or more anti-cancer nucleic acid sequences are each operably linked to a promoter. In embodiments, the promoter is a vaccinia virus early promoter. In embodiments, the promoter is a synthetic early promoter. In embodiments, the synthetic early promoter includes the sequence of SEQ ID NO:19. In embodiments, the synthetic early promoter is the sequence of SEQ ID NO:19. In embodiments, the promoter is a vaccinia virus late promoter. In embodiments, the promoter is a H5 promoter or an 11K promoter. In embodiments, the H5 promoter includes the sequence of SEQ ID NO:18. In embodiments, the H5 promoter is the sequence of SEQ ID NO:18. In embodiments, the 11K promoter includes the sequence of SEQ ID NO:20. In embodiments, the 11K promoter is the sequence of SEQ ID NO:20.

The anti-cancer nucleic acid sequence (nucleic acid binding sequence) provided herein may be incorporated into the chimeric poxvirus genome such that it is placed into functional relationship (operably linked) with a specific poxvirus gene. For example, the anti-cancer nucleic acid sequence (nucleic acid binding sequence) may be operably linked to a poxvirus gene if it affects the transcription or translation of the poxvirus gene. Generally, the anti-cancer nucleic acid sequence (nucleic acid binding sequence) and the poxvirus gene are operably linked when they are contiguous and/or in reading phase. In embodiments, the one or more anti-cancer nucleic acid sequences (one or more nucleic acid binding sequences) are operably linked to an essential gene of the chimeric poxvirus. In embodiments, the one or more anti-cancer nucleic acid sequences (one or more nucleic acid binding sequences) are operably linked to a DNA polymerase gene of the chimeric poxvirus. In embodiments, the one or more anti-cancer nucleic acid sequences (one or more nucleic acid binding sequences) are operably linked to the 3' end of a DNA polymerase gene of the chimeric poxvirus. In embodiments, the one or more anti-cancer nucleic acid sequences (one or more nucleic acid binding sequences) are operably linked to a uracil DNA glycosylase gene. In embodiments, the one or more anti-cancer nucleic acid sequences (one or more nucleic acid binding sequences) are operably linked to the 3'end of a uracil DNA glycosylase gene.

In embodiments, the one or more anti-cancer nucleic acid sequences (one or more nucleic acid binding sequences) independently encode for a miRNA binding sequence. In embodiments, the miRNA binding sequence is a miR100 binding sequence or a let7c binding sequence. In embodiments, the miRNA binding sequence is a miR100 binding sequence. In embodiments, the miR100 binding sequence includes the sequence of SEQ ID NO:9. In embodiments, the miR100 binding sequence is the sequence of SEQ ID NO:9. In embodiments, the miR100 binding sequence includes the sequence of SEQ ID NO:10. In embodiments, the miR100 binding sequence is the sequence of SEQ ID NO:10. In embodiments, the miRNA binding sequence is a let7c binding sequence. In embodiments, the let7c binding sequence includes the sequence of SEQ ID NO:11. In embodiments, the let7c binding sequence is the sequence of SEQ ID NO:11.

In embodiments, the one or more anti-cancer nucleic acid sequences are a first anti-cancer nucleic acid sequence and a second anti-cancer nucleic acid sequence. As provided herein the first anti-cancer nucleic acid sequence may be a first nucleic acid binding sequence and the second anti-cancer nucleic acid sequence may be a second nucleic acid binding sequence.

In embodiments, the first anti-cancer nucleic acid sequence encodes a sodium iodide symporter and said second anti-cancer nucleic acid sequence (second nucleic acid binding sequence) encodes a miRNA binding sequence. In embodiments, the first anti-cancer nucleic acid sequence forms part of a thymidine kinase gene and the second anti-cancer nucleic acid sequence (second nucleic acid binding sequence) is operably linked to a uracil DNA glycosylase gene. In embodiments, the first anti-cancer nucleic acid sequence forms part of a thymidine kinase gene and the second anti-cancer nucleic acid sequence (second nucleic acid binding sequence) is operably linked to a DNA polymerase gene.

In embodiments, the first anti-cancer nucleic acid sequence encodes a sodium iodide symporter and the second anti-cancer nucleic acid sequence encodes a PD-L1 inhibitor. In embodiments, the first anti-cancer nucleic acid sequence forms part of a thymidine kinase gene and the second anti-cancer nucleic acid sequence forms part of a F14.5L gene.

In embodiments, the nucleic acid sequence includes: (i) nucleic acid fragments from at least two poxvirus strains selected from the group consisting of cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS; and (ii) said detectable moiety-encoding nucleic acid sequence. In embodiments, the detectable moiety-encoding nucleic acid sequence encodes a fluorescent moiety. In embodiments, the detectable moiety-encoding nucleic acid sequence forms part of a non-essential gene of the chimeric poxvirus. In embodiments, the non-essential gene is a thymidine kinase gene. In embodiments, the parts of the non-essential gene are deleted.

In embodiments, the detectable moiety-encoding nucleic acid sequence is operably linked to a promoter. In embodiments, the promoter is a vaccinia virus early promoter. In embodiments, the promoter is a synthetic early promoter. In embodiments, the synthetic early promoter includes the sequence of SEQ ID NO:19. In embodiments, the synthetic early promoter is the sequence of SEQ ID NO:19. In embodiments, the promoter is a vaccinia virus late promoter. In embodiments, the promoter is a H5 promoter or an 11K promoter. In embodiments, the H5 promoter includes the sequence of SEQ ID NO:18. In embodiments, the H5 promoter is the sequence of SEQ ID NO:18. In embodiments, the 11K promoter includes the sequence of SEQ ID NO:20. In embodiments, the 11K promoter is the sequence of SEQ ID NO:20.

In one embodiment, the anti-cancer nucleic acid sequence (nucleic acid binding sequence) encodes a miRNA binding sequence having the sequence of SEQ ID NO:10 and is operably linked to the 3' end of a uracil DNA glycosylase gene.

In one embodiment, the anti-cancer nucleic acid sequence (nucleic acid binding sequence) encodes a miRNA binding sequence having the sequence of SEQ ID NO:9 and is operably linked to the 3' end of a uracil DNA glycosylase gene.

In one embodiment, the anti-cancer nucleic acid sequence (nucleic acid binding sequence) encodes a miRNA binding sequence having the sequence of SEQ ID NO:11 and is operably linked to the 3' end of a uracil DNA glycosylase gene.

In one embodiment, the anti-cancer nucleic acid sequence (nucleic acid binding sequence) encodes a miRNA binding sequence having the sequence of SEQ ID NO:9 and is operably linked to the 3' end of a DNA polymerase gene.

In one embodiment, the anti-cancer nucleic acid sequence (nucleic acid binding sequence) encodes a miRNA binding sequence having the sequence of SEQ ID NO:11 and is operably linked to the 3' end of a DNA polymerase gene.

In one embodiment, the thymidine kinase gene of the chimeric poxvirus has the sequence of SEQ ID NO:5.

In one embodiment, the anti-cancer nucleic acid sequence encodes a sodium iodide symporter, is operably linked to a synthetic early promoter, and forms part of a thymidine kinase gene, wherein the sodium iodide symporter has the sequence of SEQ ID NO:13 and the synthetic early promoter has the sequence of SEQ ID NO:19.

In one embodiment, the detectable moiety-encoding nucleic acid sequence encodes a fluorescent moiety having the sequence of SEQ ID NO:14, is operably linked to a H5 promoter, and forms part of a thymidine kinase gene, wherein the H5 promoter has the sequence of SEQ ID NO:18.

In one embodiment, the detectable moiety-encoding nucleic acid sequence encodes a fluorescent moiety having the sequence of SEQ ID NO:15, is operably linked to a synthetic early promoter, and forms part of a thymidine kinase gene, wherein the synthetic early promoter has the sequence of SEQ ID NO:19.

In one embodiment, the detectable moiety-encoding nucleic acid sequence encodes a fluorescent moiety having the sequence of SEQ ID NO:15, is operably linked to a H5 promoter, and forms part of a thymidine kinase gene, wherein the H5 promoter has the sequence of SEQ ID NO:18.

In one embodiment, the detectable moiety-encoding nucleic acid sequence encodes a fluorescent moiety having the sequence of SEQ ID NO:15, is operably linked to an 11K promoter, and forms part of a thymidine kinase gene, wherein the 11K promoter has the sequence of SEQ ID NO:20.

In one embodiment, the detectable moiety-encoding nucleic acid sequence encodes a fluorescent moiety having the sequence of SEQ ID NO:16, is operably linked to a H5 promoter, and forms part of a thymidine kinase gene, wherein the H5 promoter has the sequence of SEQ ID NO:18.

In one embodiment, the detectable moiety-encoding nucleic acid sequence encodes a fluorescent moiety having the sequence of SEQ ID NO:16, is operably linked to an 11K promoter, and forms part of a thymidine kinase gene, wherein the 11K promoter has the sequence of SEQ ID NO:20.

In one embodiment, the first anti-cancer nucleic acid sequence encodes a sodium iodide symporter, is operably linked to a synthetic early promoter, and forms part of a thymidine kinase gene; and the second anti-cancer nucleic acid sequence (nucleic acid binding sequence) encodes a miRNA binding sequence having the sequence of SEQ ID NO:10, and is operably linked to the 3' end of a uracil DNA glycosylase gene, wherein the sodium iodide symporter has the sequence of SEQ ID NO:13 and the synthetic early promoter has the sequence of SEQ ID NO:19.

In one embodiment, the first anti-cancer nucleic acid sequence encodes a sodium iodide symporter, is operably linked to a synthetic early promoter, and forms part of a thymidine kinase gene; and the second anti-cancer nucleic acid sequence (nucleic acid binding sequence) encodes a miRNA binding sequence having the sequence of SEQ ID NO:9, and is operably linked to the 3' end of a uracil DNA glycosylase gene, wherein the sodium iodide symporter has the sequence of SEQ ID NO:13 and the synthetic early promoter has the sequence of SEQ ID NO:19.

In one embodiment, the first anti-cancer nucleic acid sequence encodes a sodium iodide symporter, is operably linked to a synthetic early promoter, and forms part of a thymidine kinase gene; and the second anti-cancer nucleic acid sequence (nucleic acid binding sequence) encodes a miRNA binding sequence having the sequence of SEQ ID NO:11, and is operably linked to the 3' end of a uracil DNA glycosylase gene, wherein the sodium iodide symporter has the sequence of SEQ ID NO:13 and the synthetic early promoter has the sequence of SEQ ID NO:19.

In one embodiment, the first anti-cancer nucleic acid sequence encodes a sodium iodide symporter, is operably linked to a synthetic early promoter, and forms part of a thymidine kinase gene; and the second anti-cancer nucleic acid sequence (nucleic acid binding sequence) encodes a miRNA binding sequence having the sequence of SEQ ID NO:9, and is operably linked to the 3' end of a DNA polymerase gene, wherein the sodium iodide symporter has the sequence of SEQ ID NO:13 and the synthetic early promoter has the sequence of SEQ ID NO:19.

In one embodiment, the first anti-cancer nucleic acid sequence encodes a sodium iodide symporter, is operably linked to a synthetic early promoter, and forms part of a thymidine kinase gene; and the second anti-cancer nucleic acid sequence (nucleic acid binding sequence) encodes a miRNA binding sequence having the sequence of SEQ ID NO:11, and is operably linked to the 3' end of a DNA polymerase gene, wherein the sodium iodide symporter has the sequence of SEQ ID NO:13 and the synthetic early promoter has the sequence of SEQ ID NO:19.

In one embodiment, the F14.5L gene of the chimeric poxvirus has the sequence of SEQ ID NO:7.

In one embodiment, the anti-cancer nucleic acid sequence encodes an anti-PD-L1 scFv, is operably linked to a H5 promoter, and forms part of a F14.5L gene, wherein the anti-PD-L1 scFv has the sequence of SEQ ID NO:17 and the H5 promoter has the sequence of SEQ ID NO:18.

In one embodiment, the anti-cancer nucleic acid sequence encodes a sodium iodide symporter, is operably linked to a synthetic early promoter, and forms part of a thymidine kinase gene, and the F14.5L gene has the sequence of SEQ ID NO:7, wherein the sodium iodide symporter has the sequence of SEQ ID NO:13 and the synthetic early promoter has the sequence of SEQ ID NO:19.

In one embodiment, the first anti-cancer nucleic acid sequence encodes a sodium iodide symporter, is operably linked to a synthetic early promoter, and forms part of a thymidine kinase gene; and the second anti-cancer nucleic acid sequence encodes an anti-PD-L1 scFv, is operably linked to a H5 promoter and forms part of a F14.5L gene, wherein the sodium iodide symporter has the sequence of SEQ ID NO:13, the synthetic early promoter has the sequence of SEQ ID NO:19, the anti-PD-L1 scFv has the sequence of SEQ ID NO:17, and the H5 promoter has the sequence of SEQ ID NO:18.

IV. Methods of Forming a Chimeric Poxvirus

In another aspect is provided a method of forming a chimeric poxvirus, the method including: infecting a cell with at least two poxvirus strains selected from the group including cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS; and allowing the at least two poxvirus strains to replicate, thereby forming the chimeric poxvirus.

The methods of forming a chimeric poxvirus provided herein may be used to form chimeric poxviruses including transgenes (e.g., an anti-cancer nucleic acid sequence, a nucleic acid binding sequence, a detectable moiety-encoding nucleic acid sequence) as described herein.

In embodiments, the at least two poxvirus strains are each present at a multiplicity of infection of less than about 1.0. In embodiments, the at least two poxvirus strains are each present at a multiplicity of infection of less than about 0.5. In embodiments, the at least two poxvirus strains are each present at a multiplicity of infection of less than about 0.1. In embodiments, the at least two poxvirus strains are each present at a multiplicity of infection of less than about 0.05. In embodiments, the at least two poxvirus strains are each present at a multiplicity of infection of less than about 0.01.

In embodiments, the chimeric poxvirus is formed by a method including: infecting a cell with at least two poxvirus strains selected from the group including cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS; and allowing the at least two poxvirus strains to replicate, thereby forming a chimeric poxvirus.

In embodiments, the cell is infected with cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic and vaccinia virus strain AS.

In embodiments, the nucleic acid fragments are from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic and vaccinia virus strain AS.

In embodiments, the cell is infected with cowpox virus strain Brighton and raccoonpox virus strain Herman. In embodiments, the cell is infected with cowpox virus strain Brighton and rabbitpox virus strain Utrecht. In embodiments, the cell is infected with cowpox virus strain Brighton and vaccinia virus strain WR. In embodiments, the cell is infected with cowpox virus strain Brighton and vaccinia virus strain IHD. In embodiments, the cell is infected with cowpox virus strain Brighton and vaccinia virus strain Elstree. In embodiments, the cell is infected with cowpox virus strain Brighton and vaccinia virus strain CL. In embodiments, the cell is infected with cowpox virus strain Brighton and vaccinia virus strain Lederle-Chorioallantoic. In embodiments, the cell is infected with cowpox virus strain Brighton and vaccinia virus strain AS. In embodiments, the cell is infected with cowpox virus strain Brighton and orf virus strain NZ2. In embodiments, the cell is infected with cowpox virus strain Brighton and pseudocowpox virus strain TJS.

In embodiments, the cell is infected with rabbitpox virus strain Utrecht and vaccinia virus strain WR. In embodiments, the cell is infected with rabbitpox virus strain Utrecht and vaccinia virus strain IHD. In embodiments, the cell is infected with rabbitpox virus strain Utrecht and vaccinia virus strain Elstree. In embodiments, the cell is infected with rabbitpox virus strain Utrecht and vaccinia virus strain CL. In embodiments, the cell is infected with rabbitpox virus strain Utrecht and vaccinia virus strain Lederle-Chorioallantoic. In embodiments, the cell is infected with rabbitpox virus strain Utrecht and vaccinia virus strain AS. In embodiments, the cell is infected with rabbitpox virus strain Utrecht and orf virus strain NZ2. In embodiments, the cell is infected with rabbitpox virus strain Utrecht and pseudocowpox virus strain TJS.

In embodiments, the cell is infected with vaccinia virus strain WR and vaccinia virus strain IHD. In embodiments, the cell is infected with vaccinia virus strain WR and vaccinia virus strain Elstree. In embodiments, the cell is infected with vaccinia virus strain WR and vaccinia virus strain CL. In embodiments, the cell is infected with vaccinia virus strain WR and vaccinia virus strain Lederle-Chorioallantoic. In embodiments, the cell is infected with vaccinia virus strain WR and vaccinia virus strain AS. In embodiments, the cell is infected with vaccinia virus strain WR and orf virus strain NZ2. In embodiments, the cell is infected with vaccinia virus strain WR and pseudocowpox virus strain TJS.

In embodiments, the cell is infected with vaccinia virus strain IHD and vaccinia virus strain Elstree. In embodiments, the cell is infected with vaccinia virus strain IHD and vaccinia virus strain CL. In embodiments, the cell is infected with vaccinia virus strain IHD and vaccinia virus strain Lederle-Chorioallantoic. In embodiments, the cell is infected with vaccinia virus strain IHD and vaccinia virus strain AS. In embodiments, the cell is infected with vaccinia virus strain IHD and orf virus strain NZ2. In embodiments, the cell is infected with vaccinia virus strain IHD and pseudocowpox virus strain TJS.

In embodiments, the cell is infected with vaccinia virus strain Elstree and vaccinia virus strain CL. In embodiments, the cell is infected with vaccinia virus strain Elstree and vaccinia virus strain Lederle-Chorioallantoic. In embodiments, the cell is infected with vaccinia virus strain Elstree and vaccinia virus strain AS. In embodiments, the cell is infected with vaccinia virus strain Elstree and orf virus strain NZ2. In embodiments, the cell is infected with vaccinia virus strain Elstree and pseudocowpox virus strain TJS.

In embodiments, the cell is infected with vaccinia virus strain CL and vaccinia virus strain Lederle-Chorioallantoic. In embodiments, the cell is infected with vaccinia virus strain CL and vaccinia virus strain AS. In embodiments, the cell is infected with vaccinia virus strain CL and orf virus strain NZ2. In embodiments, the cell is infected with vaccinia virus strain CL and pseudocowpox virus strain TJS.

In embodiments, the cell is infected with vaccinia virus strain Lederle-Chorioallantoic and vaccinia virus strain AS. In embodiments, the cell is infected with vaccinia virus strain Lederle-Chorioallantoic and orf virus strain NZ2. In embodiments, the cell is infected with vaccinia virus strain Lederle-Chorioallantoic and pseudocowpox virus strain TJS.

In embodiments, the cell is infected with vaccinia virus strain AS and orf virus strain NZ2. In embodiments, the cell is infected with vaccinia virus strain AS and pseudocowpox virus strain TJS. In embodiments, the cell is infected with orf virus strain NZ2 and pseudocowpox virus strain TJS.

In embodiments, the cell is cell is a kidney fibroblast. In embodiments, the cell is an epithelial cell. In embodiments, the cell is cell is a CV-1 cell. In embodiments, the cell is a cow kidney epithelial cell.

V. Pharmaceutical Compositions

In an aspect is provided a pharmaceutical composition including a therapeutically effective amount of a chimeric poxvirus as described herein including embodiments thereof. In embodiments, the chimeric poxvirus includes transgenes (e.g., an anti-cancer nucleic acid sequence, a nucleic acid binding sequence, a detectable moiety-encoding nucleic acid sequence or any combination thereof).

"Pharmaceutically acceptable excipient" and "pharmaceutically acceptable carrier" refer to a substance that aids the administration of an active agent to and absorption by a subject and can be included in the compositions of the present invention without causing a significant adverse toxicological effect on the patient. Non-limiting examples of pharmaceutically acceptable excipients include water, NaCl, normal saline solutions, lactated Ringer's, normal sucrose, normal glucose, binders, fillers, disintegrants, lubricants, coatings, sweeteners, flavors, salt solutions (such as Ringer's solution), alcohols, oils, gelatins, carbohydrates such as lactose, amylose or starch, fatty acid esters, hydroxymethycellulose, polyvinyl pyrrolidine, and colors, and the like. Such preparations can be sterilized and, if desired, mixed with auxiliary agents such as lubricants, preservatives, stabilizers, wetting agents, emulsifiers, salts for influencing osmotic pressure, buffers, coloring, and/or aromatic substances and the like that do not deleteriously react with the compounds of the invention. One of skill in the art will recognize that other pharmaceutical excipients are useful in the present invention.

The chimeric poxvirus compositions provided herein including embodiments thereof may be adminstered orally, gastrointestinally, or rectally. Administration can be in the form of a single bolus dose, or may be, for example, by a continuous perfusion pump. In embodiments, the chimeric poxvirus provided herein is combined with one or more excipients, for example, a disintegrant, a filler, a glidant, or a preservative. In embodiments, the chimeric poxvirus provided herein forms part of a capsule. Suitable capsules include both hard shell capsules or soft-shelled capsules. Any lipid-based or polymer-based colloid may be used to form the capusule. Exemplary polymers useful for colloid preparations include gelatin, plant polysaccharides or their derivatives such as carrageenans and modified forms of starch and cellulose, e.g., hypromellose. Optionally, other ingredients may be added to the gelling agent solution, for example plasticizers such as glycerin and/or sorbitol to decrease the capsule's hardness, coloring agents, preservatives, disintegrants, lubricants and surface treatment.

The chimeric poxvirus compositions can be formulated in a unit dosage form, each dosage containing, for example, from about 0.005 mg to about 2000 mg of a defined chimeric poxvirus having minimal urease activity per dose. The term "unit dosage forms" refers to physically discrete units suitable as unitary dosages for human subjects and other mammals, each unit containing a predetermined quantity of active material calculated to produce the desired therapeutic effect, in association with a suitable pharmaceutical excipient. For preparing solid compositions such as tablets, the principal active ingredient is mixed with a pharmaceutical excipient to form a solid preformulation composition containing a homogeneous mixture of a compound of the present invention. When referring to these preformulation compositions as homogeneous, the active ingredient is typically dispersed evenly throughout the composition so that the composition can be readily subdivided into equally effective unit dosage forms such as tablets, pills and capsules.

In some embodiments, tablets or pills of the present invention can be coated or otherwise compounded to provide a dosage form affording the advantage of prolonged action.

For example, the tablet or pill can comprise an inner dosage and an outer dosage component, the latter being in the form of an envelope over the former. The two components can be separated by an enteric layer which serves to resist disintegration in the stomach and permit the inner component to pass intact into the duodenum or to be delayed in release. A variety of materials can be used for such enteric layers or coatings, such materials including a number of polymeric acids and mixtures of polymeric acids with such materials as shellac, cetyl alcohol, and cellulose acetate.

The liquid forms in which the compositions of the present invention can be incorporated for administration orally or by injection include aqueous solutions, suitably flavored syrups, aqueous or oil suspensions, and flavored emulsions with edible oils such as cottonseed oil, sesame oil, coconut oil, or peanut oil, as well as elixirs and similar pharmaceutical vehicles.

VI. Methods of Treatment

In an another aspect is provided a method of treating cancer in a subject in need thereof, the method including administering to the subject a therapeutically effective amount of a chimeric poxvirus as described herein including embodiments thereof, thereby treating cancer in the subject. In embodiments, the cancer is breast cancer, colon cancer, kidney cancer, leukemia, lung cancer, melanoma, ovarian cancer, prostate cancer, pancreatic cancer, brain cancer, liver cancer, gastric cancer or a sarcoma. In embodiments, the cancer is breast cancer. In embodiments, the cancer is colon cancer. In embodiments, the cancer is kidney cancer. In embodiments, the cancer is leukemia. In embodiments, the cancer is lung cancer. In embodiments, the cancer is melanoma. In embodiments, the cancer is ovarian cancer. In embodiments, the cancer is prostate cancer. In embodiments, the cancer is pancreatic cancer. In embodiments, the cancer is brain cancer. In embodiments, the cancer is liver cancer. In embodiments, the cancer is gastric cancer. In embodiments, the cancer is a sarcoma. In embodiments, the cancer is triple-negative breast cancer.

In embodiments, the administering includes administering a first chimeric poxvirus and a second chimeric poxvirus. In embodiments, the first chimeric poxvirus and the second chimeric poxvirus are administered at a combined synergistic amount. In embodiments, the first chimeric poxvirus and the second chimeric poxvirus are administered simultaneously. In embodiments, the first chimeric poxvirus and the second chimeric poxvirus are administered sequentially.

In embodiments, the poxvirus is administered with at least $10^3$ plaque forming units (Pfu)/kg. In embodiments, the poxvirus is administered at at least $10^4$ plaque forming units (Pfu)/kg. In embodiments, the poxvirus is administered at at least $10^5$ plaque forming units (Pfu)/kg. In embodiments, the poxvirus is administered at at least $10^6$ plaque forming units (Pfu)/kg. In embodiments, the poxvirus is administered at at least $10^7$ plaque forming units (Pfu)/kg. In embodiments, the poxvirus is administered at at least $10^8$ plaque forming units (Pfu)/kg.

In embodiments, the poxvirus is administered at $10^3$ plaque forming units (Pfu)/kg. In embodiments, the poxvirus is administered at $10^4$ plaque forming units (Pfu)/kg. In embodiments, the poxvirus is administered at $10^5$ plaque forming units (Pfu)/kg. In embodiments, the poxvirus is administered at $10^6$ plaque forming units (Pfu)/kg. In embodiments, the poxvirus is administered at $10^7$ plaque forming units (Pfu)/kg. In embodiments, the poxvirus is administered at $10^8$ plaque forming units (Pfu)/kg.

In embodiments, the poxvirus is administered at about $10^3$ plaque forming units (Pfu)/kg. In embodiments, the poxvirus is administered at $10^3$ plaque forming units (Pfu)/kg. In embodiments, the poxvirus is administered at about $4\times10^4$ plaque forming units (Pfu)/kg. In embodiments, the poxvirus is administered at $4\times10^4$ plaque forming units (Pfu)/kg. In embodiments, the poxvirus is administered at about $5\times10^4$ plaque forming units (Pfu)/kg. In embodiments, the poxvirus is administered at $5\times10^4$ plaque forming units (Pfu)/kg.

In an aspect is provided a method of inhibiting cell proliferation of a cell, the method including contacting a cell with a chimeric poxvirus as described herein. In embodiments, the cell is a cancer cell. In embodiments, the cancer cell is a breast cancer cell, a colon cancer cell, a kidney cancer cell, a leukemia cell, a lung cancer cell, a melanoma cell, an ovarian cancer cell, a prostate cancer cell, a pancreatic cancer cell, a brain cancer cell, a liver cancer cell, a gastric cancer cell or a sarcoma cell. In embodiments, the cancer cell is a breast cancer cell. In embodiments, the cancer cell is a colon cancer cell. In embodiments, the cancer cell is a kidney cancer cell. In embodiments, the cancer cell is a leukemia cell. In embodiments, the cancer cell is a lung cancer cell. In embodiments, the cancer cell is a melanoma. In embodiments, the cancer cell is an ovarian cancer cell. In embodiments, the cancer cell is a prostate cancer cell. In embodiments, the cancer cell is a pancreatic cancer cell. In embodiments, the cancer cell is a brain cancer cell. In embodiments, the cancer cell is a liver cancer cell. In embodiments, the cancer cell is a gastric cancer cell. In embodiments, the cancer cell is sarcoma cell. In embodiments, the cancer cell is a triple-negative breast cancer cell.

According to the methods provided herein, the subject is administered an effective amount of one or more of the agents provided herein. The terms effective amount and effective dosage are used interchangeably. The term effective amount is defined as any amount necessary to produce a desired physiologic response (e.g., treat cancer). Effective amounts and schedules for administering the agent may be determined empirically by one skilled in the art. The dosage ranges for administration are those large enough to produce the desired effect in which one or more symptoms of the disease or disorder are affected (e.g., reduced or delayed). The dosage should not be so large as to cause substantial adverse side effects, such as unwanted cross-reactions, anaphylactic reactions, and the like. Generally, the dosage will vary with the age, condition, sex, type of disease, the extent of the disease or disorder, route of administration, or whether other drugs are included in the regimen, and can be determined by one of skill in the art. The dosage can be adjusted by the individual physician in the event of any contraindications. Dosages can vary and can be administered in one or more dose administrations daily, for one or several days. Guidance can be found in the literature for appropriate dosages for given classes of pharmaceutical products. For example, for the given parameter, an effective amount will show an increase or decrease of at least 5%, 10%, 15%, 20%, 25%, 40%, 50%, 60%, 75%, 80%, 90%, or at least 100%. Efficacy can also be expressed as "-fold" increase or decrease. For example, a therapeutically effective amount can have at least a 1.2-fold, 1.5-fold, 2-fold, 5-fold, or more effect over a control. The exact dose and formulation will depend on the purpose of the treatment, and will be ascertainable by one skilled in the art using known techniques (see, e.g., Lieberman, Pharmaceutical Dosage Forms (vols. 1-3, 1992); Lloyd, The Art, Science and Technology of Pharmaceutical Compounding (1999); Remington: The Science and Practice of Pharmacy, 20th Edition, Gennaro, Editor (2003), and Pickar, Dosage Calculations (1999)).

For prophylactic use, a therapeutically effective amount of the chimeric poxvirus composition described herein are administered to a subject prior to or during early onset (e.g., upon initial signs and symptoms of cancer). Therapeutic treatment involves administering to a subject a therapeutically effective amount of the agents described herein after diagnosis or development of disease. Thus, in another aspect, a method of treating a disease (e.g., cancer) in a subject in need thereof is provided.

The terms "subject," "patient," "individual," etc. are not intended to be limiting and can be generally interchanged. That is, an individual described as a "patient" does not necessarily have a given disease, but may be merely seeking medical advice.

As used herein, "treating" or "treatment of" a condition, disease or disorder or symptoms associated with a condition, disease or disorder refers to an approach for obtaining beneficial or desired results, including clinical results. Beneficial or desired clinical results can include, but are not limited to, alleviation or amelioration of one or more symptoms or conditions, diminishment of extent of condition, disorder or disease, stabilization of the state of condition, disorder or disease, prevention of development of condition, disorder or disease, prevention of spread of condition, disorder or disease, delay or slowing of condition, disorder or disease progression, delay or slowing of condition, disorder or disease onset, amelioration or palliation of the condition, disorder or disease state, and remission, whether partial or total. "Treating" can also mean prolonging survival of a subject beyond that expected in the absence of treatment. "Treating" can also mean inhibiting the progression of the condition, disorder or disease, slowing the progression of the condition, disorder or disease temporarily, although in some instances, it involves halting the progression of the condition, disorder or disease permanently. As used herein the terms treatment, treat, or treating refers to a method of reducing the effects of one or more symptoms of a disease or condition characterized by expression of the protease or symptom of the disease or condition characterized by expression of the protease. Thus in the disclosed method, treatment can refer to a 10%, 20%, 30%, 40%, 50%, 60%, 70%, 80%, 90%, or 100% reduction in the severity of an established disease, condition, or symptom of the disease or condition (e.g., cancer). For example, a method for treating a disease is considered to be a treatment if there is a 10% reduction in one or more symptoms of the disease in a subject as compared to a control. Thus the reduction can be a 10%, 20%, 30%, 40%, 50%, 60%, 70%, 80%, 90%, 100%, or any percent reduction in between 10% and 100% as compared to native or control levels. It is understood that treatment does not necessarily refer to a cure or complete ablation of the disease, condition, or symptoms of the disease or condition. Further, as used herein, references to decreasing, reducing, or inhibiting include a change of 10%, 20%, 30%, 40%, 50%, 60%, 70%, 80%, 90% or greater as compared to a control level and such terms can include but do not necessarily include complete elimination.

Regardless of how the chimeric poxvirus compositions are formulated, the dosage required will depend on the route of administration, the nature of the formulation, the nature of the subject's condition, e.g., immaturity of the immune system or a gastrointestinal disorder, the subject's size, weight, surface area, age, and sex, other drugs being administered, and the judgment of the attending clinicians. Alternatively or in addition, the dosage can be expressed as Pfu/kg of dry weight.

Administrations can be single or multiple (e.g., 2- or 3-, 4-, 6-, 8-, 10-, 20-, 50-, 100-, 150-, or more fold). The duration of treatment with any composition provided herein can be any length of time from as short as one day to as long as the life span of the host (e.g., many years). For example, a composition can be administered once a week (for, for example, 4 weeks to many months or years); once a month (for example, three to twelve months or for many years); or once a year for a period of 5 years, ten years, or longer. It is also noted that the frequency of treatment can be variable. For example, the present compositions can be administered once (or twice, three times, etc.) daily, weekly, monthly, or yearly.

The compositions may also be administered in conjunction with other therapeutic agents. In embodiments, the compositions may also be administered in conjunction with anti-cancer agents. Other therapeutic agents will vary according to the particular disorder, but can include, for example, dietary modification, hemodialysis, therapeutic agents such as sodium benzoate, phenylacetate, arginine, or surgical remedies. Concurrent administration of two or more therapeutic agents does not require that the agents be administered at the same time or by the same route, as long as there is an overlap in the time period during which the agents are exerting their therapeutic effect. Simultaneous or sequential administration is contemplated, as is administration on different days or weeks.

The compounds described herein can be used in combination with one another, with other active agents (e.g. anti-cancer agents) known to be useful in treating a disease described herein (e.g. breast cancer, colon cancer, kidney cancer, leukemia, lung cancer, melanoma, ovarian cancer, prostate cancer, pancreatic cancer, brain cancer, liver cancer, gastric cancer or a sarcoma), or with adjunctive agents that may not be effective alone, but may contribute to the efficacy of the active agent.

In embodiments, the method includes administering a therapeutic agent. In embodiments, the therapeutic agent is a checkpoint inhibitor protein. In embodiments, the therapeutic agent is ipilimumab. In embodiments, the therapeutic agent is pembrolizumab. In embodiments, the therapeutic agent is nivolumab. In embodiments, the therapeutic agent is talimogene laherparepvec. In embodiments, the therapeutic agent is durvalumab. In embodiments, the therapeutic agent is daclizumab. In embodiments, the therapeutic agent is avelumab. In embodiments, the therapeutic agent is atezolizumab. In embodiments, the chimeric poxvirus and the therapeutic agent are administered at a combined synergistic amount. In embodiments, the chimeric poxvirus and the therapeutic agent are administered simultaneously. In embodiments, the chimeric poxvirus and the therapeutic agent are administered sequentially.

In some embodiments, co-administration includes administering one active agent within 0.5, 1, 2, 4, 6, 8, 10, 12, 16, 20, or 24 hours of a second active agent (e.g. anti-cancer agent). Co-administration includes administering two active agents simultaneously, approximately simultaneously (e.g., within about 1, 5, 10, 15, 20, or 30 minutes of each other), or sequentially in any order. In some embodiments, co-administration can be accomplished by co-formulation, i.e., preparing a single pharmaceutical composition including both active agents. In other embodiments, the active agents can be formulated separately. In another embodiment, the active and/or adjunctive agents may be linked or conjugated to one another.

"Anti-cancer agent" is used in accordance with its plain ordinary meaning and refers to a composition (e.g. compound, drug, antagonist, inhibitor, modulator) having antineoplastic properties or the ability to inhibit the growth or proliferation of cells. In some embodiments, an anti-cancer agent is a chemotherapeutic. In some embodiments, an anti-cancer agent is an agent identified herein having utility in methods of treating cancer. In some embodiments, an anti-cancer agent is an agent approved by the FDA or similar regulatory agency of a country other than the USA, for treating cancer. Examples of anti-cancer agents include, but are not limited to, MEK (e.g. MEK1, MEK2, or MEK1 and MEK2) inhibitors (e.g. XL518, CI-1040, PD035901, selumetinib/AZD6244, GSK1120212/trametinib, GDC-0973, ARRY-162, ARRY-300, AZD8330, PD0325901, U0126, PD98059, TAK-733, PD318088, AS703026, BAY 869766), alkylating agents (e.g., cyclophosphamide, ifosfamide, chlorambucil, busulfan, melphalan, mechlorethamine, uramustine, thiotepa, nitrosoureas, nitrogen mustards (e.g., mechloroethamine, cyclophosphamide, chlorambucil, meiphalan), ethylenimine and methylmelamines (e.g., hexamethlymelamine, thiotepa), alkyl sulfonates (e.g., busulfan), nitrosoureas (e.g., carmustine, lomusitne, semustine, streptozocin), triazenes (decarbazine)), anti-metabolites (e.g., 5-azathioprine, leucovorin, capecitabine, fludarabine, gemcitabine, pemetrexed, raltitrexed, folic acid analog (e.g., methotrexate), or pyrimidine analogs (e.g., fluorouracil, floxouridine, Cytarabine), purine analogs (e.g., mercaptopurine, thioguanine, pentostatin), etc.), plant alkaloids (e.g., vincristine, vinblastine, vinorelbine, vindesine, podophyllotoxin, paclitaxel, docetaxel, etc.), topoisomerase inhibitors (e.g., irinotecan, topotecan, amsacrine, etoposide (VP16), etoposide phosphate, teniposide, etc.), antitumor antibiotics (e.g., doxorubicin, adriamycin, daunorubicin, epirubicin, actinomycin, bleomycin, mitomycin, mitoxantrone, plicamycin, etc.), platinum-based compounds or platinum containing agents (e.g. cisplatin, oxaloplatin, carboplatin), anthracenedione (e.g., mitoxantrone), substituted urea (e.g., hydroxyurea), methyl hydrazine derivative (e.g., procarbazine), adrenocortical suppressant (e.g., mitotane, aminoglutethimide), epipodophyllotoxins (e.g., etoposide), antibiotics (e.g., daunorubicin, doxorubicin, bleomycin), enzymes (e.g., L-asparaginase), inhibitors of mitogen-activated protein kinase signaling (e.g. U0126, PD98059, PD184352, PD0325901, ARRY-142886, SB239063, SP600125, BAY 43-9006, wortmannin, or LY294002, Syk inhibitors, mTOR inhibitors, antibodies (e.g., rituxan), gossyphol, genasense, polyphenol E, Chlorofusin, all trans-retinoic acid (ATRA), bryostatin, tumor necrosis factor-related apoptosis-inducing ligand (TRAIL), 5-aza-2'-deoxycytidine, all trans retinoic acid, doxorubicin, vincristine, etoposide, gemcitabine, imatinib (GLEEVEC™), geldanamycin, 17-N-Allylamino-17-Demethoxygeldanamycin (17-AAG), flavopiridol, LY294002, bortezomib, trastuzumab, BAY 11-7082, PKC412, PD184352, 20-epi-1, 25 dihydroxyvitamin D3; 5-ethynyluracil; abiraterone; aclarubicin; acylfulvene; adecypenol; adozelesin; aldesleukin; ALL-TK antagonists; altretamine; ambamustine; amidox; amifostine; aminolevulinic acid; amrubicin; amsacrine; anagrelide; anastrozole; andrographolide; angiogenesis inhibitors; antagonist D; antagonist G; antarelix; anti-dorsalizing morphogenetic protein-1; antiandrogen, prostatic carcinoma; antiestrogen; antineoplaston; antisense oligonucleotides; aphidicolin glycinate; apoptosis gene modulators; apoptosis regulators; apurinic acid; ara-CDP-DL-PTBA; arginine deaminase; asulacrine; atamestane; atrimustine; axinastatin 1; axinastatin 2; axinastatin 3; azasetron; azatoxin; azatyrosine; baccatin III derivatives; balanol; batimastat; BCR/ABL antagonists; benzochlorins; benzoylstaurosporine; beta lactam derivatives; beta-alethine; betaclamycin B; betulinic acid; bFGF inhibitor; bicalutamide; bisantrene; bisaziridinylspermine; bisnafide; bistratene A; bizelesin; breflate; bropirimine; budotitane; buthionine sulfoximine; calcipotriol; calphostin C; camptothecin derivatives; canarypox IL-2; capecitabine; carboxamide-amino-triazole; carboxyamidotriazole; CaRest M3; CARN 700; cartilage derived inhibitor; carzelesin; casein kinase inhibitors (ICOS); castanospermine; cecropin B; cetrorelix; chlorins; chloroquinoxaline sulfonamide; cicaprost; cis-porphyrin; cladribine; clomifene analogues; clotrimazole; collismycin A; collismycin B; combretastatin A4; combretastatin analogue; conagenin; crambescidin 816; crisnatol; cryptophycin 8; cryptophycin A derivatives; curacin A; cyclopentanthraquinones; cycloplatam; cypemycin; cytarabine ocfosfate; cytolytic factor; cytostatin; dacliximab; decitabine; dehydrodidemnin B; deslorelin; dexamethasone; dexifosfamide; dexrazoxane; dexverapamil; diaziquone; didemnin B; didox; diethylnorspermine; dihydro-5-azacytidine; 9-dioxamycin; diphenyl spiromustine; docosanol; dolasetron; doxifluridine; droloxifene; dronabinol; duocarmycin SA; ebselen; ecomustine; edelfosine; edrecolomab; eflornithine; elemene; emitefur; epirubicin; epristeride; estramustine analogue; estrogen agonists; estrogen antagonists; etanidazole; etoposide phosphate; exemestane; fadrozole; fazarabine; fenretinide; filgrastim; finasteride; flavopiridol; flezelastine; fluasterone; fludarabine; fluorodaunorunicin hydrochloride; forfenimex; formestane; fostriecin; fotemustine; gadolinium texaphyrin; gallium nitrate; galocitabine; ganirelix; gelatinase inhibitors; gemcitabine; glutathione inhibitors; hepsulfam; heregulin; hexamethylene bisacetamide; hypericin; ibandronic acid; idarubicin; idoxifene; idramantone; ilmofosine; ilomastat; imidazoacridones; imiquimod; immunostimulant peptides; insulin-like growth factor-1 receptor inhibitor; interferon agonists; interferons; interleukins; iobenguane; iododoxorubicin; ipomeanol, 4-; iroplact; irsogladine; isobengazole; isohomohalicondrin B; itasetron; jasplakinolide; kahalalide F; lamellarin-N triacetate; lanreotide; leinamycin; lenograstim; lentinan sulfate; leptolstatin; letrozole; leukemia inhibiting factor; leukocyte alpha interferon; leuprolide+estrogen+progesterone; leuprorelin; levamisole; liarozole; linear polyamine analogue; lipophilic disaccharide peptide; lipophilic platinum compounds; lissoclinamide 7; lobaplatin; lombricine; lometrexol; lonidamine; losoxantrone; lovastatin; loxoribine; lurtotecan; lutetium texaphyrin; lysofylline; lytic peptides; maitansine; mannostatin A; marimastat; masoprocol; maspin; matrilysin inhibitors; matrix metalloproteinase inhibitors; menogaril; merbarone; meterelin; methioninase; metoclopramide; MIF inhibitor; mifepristone; miltefosine; mirimostim; mismatched double stranded RNA; mitoguazone; mitolactol; mitomycin analogues; mitonafide; mitotoxin fibroblast growth factor-saporin; mitoxantrone; mofarotene; molgramostim; monoclonal antibody, human chorionic gonadotrophin; monophosphoryl lipid A+myobacterium cell wall sk; mopidamol; multiple drug resistance gene inhibitor; multiple tumor suppressor 1-based therapy; mustard anticancer agent; mycaperoxide B; mycobacterial cell wall extract; myriaporone; N-acetyldinaline; N-substituted benzamides; nafarelin; nagrestip; naloxone+pentazocine; napavin; naphterpin; nartograstim; nedaplatin; nemorubicin; neridronic acid; neutral endopeptidase; nilutamide; nisamycin; nitric oxide modulators; nitroxide antioxidant; nitrullyn; 06-benzylguanine; octreotide; okicenone; oligonucleotides; onapristone; ondansetron; ondansetron; oracin; oral cytokine inducer; ormaplatin; osaterone; oxaliplatin; oxaunomycin; palauamine; palmitoylrhizoxin; pamidronic acid; panaxytriol; panomifene; parabactin; pazelliptine; pegaspargase; peldesine; pentosan polysulfate sodium; pentostatin; pentrozole; perflubron; perfosfamide; perillyl alcohol; phenazinomycin; phenyl acetate; phosphatase inhibitors; picibanil; pilocarpine hydrochloride; pirarubicin; piritrexim; placetin A; placetin B; plasminogen activator inhibitor; platinum complex; platinum compounds; platinum-triamine complex; porfimer sodium; porfiromycin; prednisone; propyl bis-acridone; prostaglandin J2; proteasome inhibitors; protein A-based immune modulator; protein kinase C inhibitor; protein kinase C inhibitors, microalgal; protein tyrosine phosphatase inhibitors; purine nucleoside phosphorylase inhibitors; purpurins; pyrazoloacridine; pyridoxylated hemoglobin polyoxyethylerie conjugate; raf antagonists; raltitrexed; ramosetron; ras farnesyl protein transferase inhibitors; ras inhibitors; ras-GAP inhibitor; retelliptine demethylated; rhenium Re 186 etidronate; rhizoxin; ribozymes; RII retinamide; rogletimide; rohitukine; romurtide; roquinimex; rubiginone B 1; ruboxyl; safingol; saintopin; SarCNU; sarcophytol A; sargramostim; Sdi 1 mimetics; semustine; senescence derived inhibitor 1; sense oligonucleotides; signal transduction inhibitors; signal transduction modulators; single chain antigen-binding protein; sizofuran; sobuzoxane; sodium borocaptate; sodium phenylacetate; solverol; somatomedin binding protein; sonermin; sparfosic acid; spicamycin D; spiromustine; splenopentin; spongistatin 1; squalamine; stem cell inhibitor; stem-cell division inhibitors; stipiamide; stromelysin inhibitors; sulfinosine; superactive vasoactive intestinal peptide antagonist; suradista; suramin; swainsonine; synthetic glycosaminoglycans; tallimustine; tamoxifen methiodide; tauromustine; tazarotene; tecogalan sodium; tegafur; tellurapyrylium; telomerase inhibitors; temoporfin; temozolomide; teniposide; tetrachlorodecaoxide; tetrazomine; thaliblastine; thiocoraline; thrombopoietin; thrombopoietin mimetic; thymalfasin; thymopoietin receptor agonist; thymotrinan; thyroid stimulating hormone; tin ethyl etiopurpurin; tirapazamine; titanocene bichloride; topsentin; toremifene; totipotent stem cell factor; translation inhibitors; tretinoin; triacetyluridine; triciribine; trimetrexate; triptorelin; tropisetron; turosteride; tyrosine kinase inhibitors; tyrphostins; UBC inhibitors; ubenimex; urogenital sinus-derived growth inhibitory factor; urokinase receptor antagonists; vapreotide; variolin B; vector system, erythrocyte gene therapy; velaresol; veramine; verdins; verteporfin; vinorelbine; vinxaltine; vitaxin; vorozole; zanoterone; zeniplatin; zilascorb; zinostatin stimalamer, Adriamycin, Dactinomycin, Bleomycin, Vinblastine, Cisplatin, acivicin; aclarubicin; acodazole hydrochloride; acronine; adozelesin; aldesleukin; altretamine; ambomycin; ametantrone acetate; aminoglutethimide; amsacrine; anastrozole; anthramycin; asparaginase; asperlin; azacitidine; azetepa; azotomycin; batimastat; benzodepa; bicalutamide; bisantrene hydrochloride; bisnafide dimesylate; bizelesin; bleomycin sulfate; brequinar sodium; bropirimine; busulfan; cactinomycin; calusterone; caracemide; carbetimer; carboplatin; carmustine; carubicin hydrochloride; carzelesin; cedefingol; chlorambucil; cirolemycin; cladribine; crisnatol mesylate; cyclophosphamide; cytarabine; dacarbazine; daunorubicin hydrochloride; decitabine; dexormaplatin; dezaguanine; dezaguanine mesylate; diaziquone; doxorubicin; doxorubicin hydrochloride; droloxifene; droloxifene citrate; dromostanolone propionate; duazomycin; edatrexate; eflornithine hydrochloride; elsamitrucin; enloplatin; enpromate; epipropidine; epirubicin hydrochloride; erbulozole; esorubicin hydrochloride; estramustine; estramustine phosphate sodium; etanidazole; etoposide; etoposide phosphate; etoprine; fadrozole hydrochloride; fazarabine; fenretinide; floxuridine; fludarabine phosphate; fluorouracil; flurocitabine; fosquidone; fostriecin sodium; gemcitabine; gemcitabine hydrochloride; hydroxyurea; idarubicin hydrochloride; ifosfamide; iimofosine; interleukin (including recombinant interleukin II, or rlL.sub.2), interferon alfa-2a; interferon alfa-2b; interferon alfa-n1; interferon alfa-n3; interferon beta-la; interferon gamma-1b; iproplatin; irinotecan hydrochloride; lanreotide acetate; letrozole; leuprolide acetate; liarozole hydrochloride; lometrexol sodium; lomustine; losoxantrone hydrochloride; masoprocol; maytansine; mechlorethamine hydrochloride; megestrol acetate; melengestrol acetate; melphalan; menogaril; mercaptopurine; methotrexate; methotrexate sodium; metoprine; meturedepa; mitindomide; mitocarcin; mitocromin; mitogillin; mitomalcin; mitomycin; mitosper; mitotane; mitoxantrone hydrochloride; mycophenolic acid; nocodazoie; nogalamycin; ormaplatin; oxisuran; pegaspargase; peliomycin; pentamustine; peplomycin sulfate; perfosfamide; pipobroman; piposulfan; piroxantrone hydrochloride; plicamycin; plomestane; porfimer sodium; porfiromycin; prednimustine; procarbazine hydrochloride; puromycin; puromycin hydrochloride; pyrazofurin; riboprine; rogletimide; safingol; safingol hydrochloride; semustine; simtrazene; sparfosate sodium; sparsomycin; spirogermanium hydrochloride; spiromustine; spiroplatin; streptonigrin; streptozocin; sulofenur; talisomycin; tecogalan sodium; tegafur; teloxantrone hydrochloride; temoporfin; teniposide; teroxirone; testolactone; thiamiprine; thioguanine; thiotepa; tiazofurin; tirapazamine; toremifene citrate; trestolone acetate; triciribine phosphate; trimetrexate; trimetrexate glucuronate; triptorelin; tubulozole hydrochloride; uracil mustard; uredepa; vapreotide; verteporfin; vinblastine sulfate; vincristine sulfate; vindesine; vindesine sulfate; vinepidine sulfate; vinglycinate sulfate; vinleurosine sulfate; vinorelbine tartrate; vinrosidine sulfate; vinzolidine sulfate; vorozole; zeniplatin; zinostatin; zorubicin hydrochloride, agents that arrest cells in the G2-M phases and/or modulate the formation or stability of microtubules, (e.g. TAXOL' (i.e. paclitaxel), TAXOTERE' (i.e. docetaxel), compounds comprising the taxane skeleton, Erbulozole (i.e. R-55104), Dolastatin 10 (i.e. DLS-10 and NSC-376128), Mivobulin isethionate (i.e. as CI-980), Vincristine, NSC-639829, Discodermolide (i.e. as NVP-XX-A-296), ABT-751 (Abbott, i.e. E-7010), Altorhyrtins (e.g. Altorhyrtin A and Altorhyrtin C), Spongistatins (e.g. Spongistatin 1, Spongistatin 2, Spongistatin 3, Spongistatin 4, Spongistatin 5, Spongistatin 6, Spongistatin 7, Spongistatin 8, and Spongistatin 9), Cemadotin hydrochloride (i.e. LU-103793 and NSC-D-669356), Epothilones (e.g. Epothilone A, Epothilone B, Epothilone C (i.e. desoxyepothilone A or dEpoA), Epothilone D (i.e. KOS-862, dEpoB, and desoxyepothilone B), Epothilone E, Epothilone F, Epothilone B N-oxide, Epothilone A N-oxide, 16-aza-epothilone B, 21-aminoepothilone B (i.e. BMS-310705), 21-hydroxyepothilone D (i.e. Desoxyepothilone F and dEpoF), 26-fluoroepothilone, Auristatin PE (i.e. NSC-654663), Soblidotin (i.e. TZT-1027), Vincristine sulfate, Cryptophycin 52 (i.e. LY-355703), Vitilevuamide, Tubulysin A, Canadensol, Centaureidin (i.e. NSC-106969), Oncocidin A1 (i.e. BTO-956 and DIME), Fijianolide B, Laulimalide, Narcosine (also known as NSC-5366), Nascapine, Hemiasterlin, Vanadocene acetylacetonate, Monsatrol, lnanocine (i.e. NSC-698666), Eleutherobins (such as Desmethyleleutherobin, Desaetyleleutherobin, lsoeleutherobin A, and Z-Eleutherobin), Caribaeoside, Caribaeolin, Halichondrin B, Diazonamide A, Taccalonolide A, Diozostatin, (−)-Phenylahistin (i.e. NSCL-96F037), Myoseverin B, Resverastatin phosphate sodium, steroids (e.g., dexamethasone), finasteride, aromatase inhibitors, gonadotropin-releasing hormone agonists (GnRH) such as goserelin or leuprolide, adrenocorticosteroids (e.g., prednisone), progestins (e.g., hydroxyprogesterone caproate, megestrol acetate, medroxyprogesterone acetate), estrogens (e.g., diethlystilbestrol, ethinyl estradiol), antiestrogen (e.g., tamoxifen), androgens (e.g., testosterone propionate, fluoxymesterone), antiandrogen (e.g., flutamide), immunostimulants (e.g., Bacillus Calmette-Guerin (BCG), levamisole, interleukin-2, alpha-interferon, etc.), monoclonal antibodies (e.g., anti-CD20, anti-HER2, anti-CD52, anti-HLA-DR, and anti-VEGF monoclonal antibodies), immunotoxins (e.g., anti-CD33 monoclonal antibody-calicheamicin conjugate, anti-CD22 monoclonal antibody-pseudomonas exotoxin conjugate, etc.), radioimmunotherapy (e.g., anti-CD20 monoclonal antibody conjugated to $^{111}In$, $^{90}Y$, or $^{131}I$, etc.), triptolide, homoharringtonine, dactinomycin, doxorubicin, epirubicin, topotecan, itraconazole, vindesine, cerivastatin, vincristine, deoxyadenosine, sertraline, pitavastatin, irinotecan, clofazimine, 5-nonyloxytryptamine, vemurafenib, dabrafenib, erlotinib, gefitinib, EGFR inhibitors, epidermal growth factor receptor (EGFR)-targeted therapy or therapeutic (e.g. gefitinib (IRESSA™) erlotinib (TARCEVA™), cetuximab (ERBITUX™), lapatinib (TYKERB™), panitumumab (VECTIBIX™), vandetanib (CAPRELSA™), afatinib/BIBW2992, CI-1033/canertinib, neratinib/HKI-272, CP-724714, TAK-285, AST-1306, ARRY334543, ARRY-380, AG-1478, dacomitinib/PF299804, OSI-420/desmethyl erlotinib, AZD8931, AEE788, pelitinib/EKB-569, CUDC-101, WZ8040, WZ4002, WZ3146, AG-490, XL647, PD153035, BMS-599626.

VII. Methods of Detection

In an another aspect is provided a method of detecting cancer in a subject in need thereof, the method including contacting a cancer cell with a chimeric poxvirus as described herein including embodiments thereof and allowing the chimeric poxvirus to replicate, thereby detecting a cancer cell. In embodiments, the chimeric poxvirus includes a detectable-moeity encoding nucleic acid sequence. In embodiments, the detectable-moeity encoding nucleic acid sequence encodes a fluorescent moiety. In embodiments, the detectable-moeity encoding nucleic acid sequence encodes mCherry. In embodiments, the detectable-moeity encoding nucleic acid sequence encodes Emerald. In embodiments, the detectable-moeity encoding nucleic acid sequence encodes firefly luciferase. In embodiments, the cancer cell is in a subject. In embodiments, the subject is a mammal. In embodiments, the subject is a human.

EXAMPLES

The following examples are offered to illustrate, but not to limit the claimed invention.

Example 1. Novel Potent Chimeric Poxviruses for Oncolytic Immunotherapy of Cancer Cancer is the second leading cause of death in the United States. In recent years, great progress has been made in cancer immunotherapy, including immune checkpoint inhibitors, T cells with chimeric antigen receptors, and oncolytic viruses.

Oncolytic viruses are naturally occurring or genetically modified viruses that infect, replicate in, and eventually kill cancer cells while leaving healthy cells unharmed (1, 2). A recently completed Phase III clinical trial of the oncolytic herpes simplex virus T-VEC in 436 patients with unresectable stage IIIB, IIIC or IV melanoma was reported to meet its primary end point, with a durable response rate of 16.3% in patients receiving T-VEC compared to 2.1% in patients receiving GM-CSF (3). Based on the results from this trial, FDA approved T-VEC on Oct. 27, 2015. The approval of the first oncolytic virus by the FDA paved the way for a promising field.

Oncolytic virus constructs from at least eight different species have been tested in various phases of clinical trials, including adenovirus, herpes simplex virus-1, Newcastle disease virus, reovirus, measles virus, coxsackievirus, Seneca Valley virus, and vaccinia virus. It has become clear that oncolytic viruses are well tolerated in patients with cancer. The clinical benefits of oncolytic viruses as stand-alone treatments, however, remain limited (5). Due to concerns on the safety of oncolytic viruses, only highly attenuated oncolytic viruses (either naturally avirulent or attenuated through genetic engineering) have been used in both preclinical and clinical studies. Since the safety of oncolytic viruses has now been well established it is time to design and test oncolytic viruses with maximal anti-tumor potency. Oncolytic viruses with a robust oncolytic effect will release abundant tumor antigens, resulting in a strong immunotherapeutic effect.

Vaccinia virus, the prototype member of the poxvirus family, was used as smallpox vaccine to eradicate smallpox that is estimated to have killed 500 million people just in the $19^{th}$ and $20^{th}$ centuries. It, thus, is arguably the most successful live biotherapeutic agent. The safety of vaccinia virus was well demonstrated in millions of people worldwide. Vaccinia virus is also the first oncolytic virus showing viral oncolysis in the laboratory. Vaccinia virus as an oncolytic virus has been tested in many clinical trials and has been shown to be well tolerated in patients with late-stage cancer (2). Several studies show that in terms of oncolytic activity vaccinia virus is superior to adenovirus (6), one of the best studied oncolytic virus species and the first oncolytic virus approved for cancer treatment in China (7). Besides vaccinia virus, other members in the poxvirus family were also tested as oncolytic viruses, including raccoonpox virus (8), orf virus (9), and myxoma virus (10).

Chimeric poxviruses have potential to combine favorable features from different virus species, thus, are superior to individual wild-type viruses. Since orthopoxviruses and parapoxviruses are antigenically distinct the potent chimeric orthopoxvirus and the potent chimeric parapoxvirus generated in this study can be potentially combined into the same treatment regimen to achieve the maximum therapeutic efficacy. Applicants have generated pools of chimeric orthopoxviruses and chimeric parapoxviruses. Several chimeric orthopoxvirus and parapoxvirus isolates showed superior killing capacity in a panel of the NCI 60 cancer cell lines compared to their parental individual wild-type viruses.

Generation of chimeric virus pools and isolation of individual chimeric viruses. A pool of chimeric orthopoxviruses was generated by co-infecting CV-1 cells with cowpox virus strain Brighton, raccoonpox virus strain Herman, rabbitpox virus strain Utrecht, and vaccinia virus strains WR, IHD, Elstree, CL, Lederle-Chorioallantoic and AS at a multiplicity of infection (MOI) of 0.01 per virus. To generate a pool of chimeric parapoxviruses, MDBK cells were co-infected with orf virus strain NZ2 and pseudocowpox virus strain TJS at an MOI of 0.1. Applicants' pilot experiments indicate that CV-1 cells are susceptible to all the orthopoxviruses used in this study and that both orf virus and pseudocowpox virus infect and form plaques in MDBK cells.

100 chimeric orthopoxvirus plaques and 100 chimeric parapoxvirus plaques were picked from CV-1 cells infected with the chimeric orthopoxvirus pool and MDBK cells infected with the chimeric parapoxvirus pool, respectively.

These two hundred plaques were further plaque-purified two more times in respective cells to yield 200 clonally purified individual chimeric virus isolates. Viruses #14-113 are chimeric orthopoxvirus isolates whereas viruses #114-213 are chimeric parapoxvirus isolates.

Identification of novel potent chimeric poxvirus isolates by high throughput screening in the NCI-60 cell lines. Tumor cell-killing activity of 200 chimeric orthopoxvirus and chimeric parapoxvirus isolates, together with 11 parental virus strains and 2 control oncolytic viruses (GLV-1h68 and OncoVEX GFP) were evaluated and compared in a panel of the NCI-60 cell lines (Table 1). GLV-1h68 is one of the best studied oncolytic vaccinia viruses, and is currently in clinical development. OncoVEX GFP has the same backbone as T-VEC, an oncolytic herpes simplex virus-1 and the first oncolytic virus approved by the FDA. Each cell line was infected with each virus at an MOI of 0.01. Cell viability was measured at 96 h post infection using MTS assays. The virus amount used (MOI 0.01) in this high throughput screening experiment was intentionally kept low, and optimized to compare cell killing in adherent cell lines (the majority of cell lines in the NCI-60 panel are adherent cells) so potent new virus isolates can stand out. This amount of virus, however, was too low to see any significant and consistent cell killing in suspension cell lines. Therefore, the results from 6 leukemia cell lines were not included in the analysis for the purpose of virus comparison.

TABLE 1

Catalog of the NCI-60 cell lines

| Name | Species | Organ of Origin | Culture |
|---|---|---|---|
| BT549 | Human | Breast | Adherent |
| HS 578T | Human | Breast | Adherent |
| MCF7 | Human | Breast | Adherent |
| MDA-MB-231 | Human | Breast | Adherent |
| MDA-MB-468 | Human | Breast | Adherent |
| T-47D | Human | Breast | Adherent |
| SF268 | Human | CNS | Adherent |
| SF295 | Human | CNS | Adherent |
| SF539 | Human | CNS | Adherent |
| SNB-19 | Human | CNS | Adherent |
| SNB-75 | Human | CNS | Adherent |
| U251 | Human | CNS | Adherent |
| Colo205 | Human | Colon | Adherent & Suspension |
| HCC 2998 | Human | Colon | Adherent |
| HCT-116 | Human | Colon | Adherent |
| HCT-15 | Human | Colon | Adherent |
| HT29 | Human | Colon | Adherent |
| KM12 | Human | Colon | Adherent |
| SW620 | Human | Colon | Adherent |
| 786-O | Human | Kidney | Adherent |
| A498 | Human | Kidney | Adherent |
| ACHN | Human | Kidney | Adherent |
| CAKI | Human | Kidney | Adherent |
| RXF 393 | Human | Kidney | Adherent |
| SN12C | Human | Kidney | Adherent |
| TK-10 | Human | Kidney | Adherent |
| UO-31 | Human | Kidney | Adherent |
| CCRF-CEM | Human | Leukemia | Suspension |
| HL-60 | Human | Leukemia | Suspension |
| K562 | Human | Leukemia | Suspension |
| MOLT-4 | Human | Leukemia | Suspension |
| RPMI-8226 | Human | Leukemia | Suspension |
| SR | Human | Leukemia | Suspension |
| A549 | Human | Lung | Adherent |
| EKVX | Human | Lung | Adherent |
| HOP-62 | Human | Lung | Adherent |
| HOP-92 | Human | Lung | Adherent & Suspension |
| NCI-H226 | Human | Lung | Adherent |

TABLE 1-continued

Catalog of the NCI-60 cell lines

| Name | Species | Organ of Origin | Culture |
|---|---|---|---|
| NCI-H23 | Human | Lung | Adherent |
| NCI-H322M | Human | Lung | Suspension |
| NCI-H460 | Human | Lung | Adherent |
| NCI-H522 | Human | Lung | Adherent |
| LOX IMVI | Human | Melanoma | Semi-Adherent |
| M14 | Human | Melanoma | Adherent |
| MALME-3M | Human | Melanoma | Adherent & Suspension |
| MDA-MB-435 | Human | Melanoma | Adherent |
| SK-MEL-2 | Human | Melanoma | Adherent |
| SK-MEL-28 | Human | Melanoma | Adherent |
| SK-MEL-5 | Human | Melanoma | Adherent |
| UACC-257 | Human | Melanoma | Adherent |
| UACC-62 | Human | Melanoma | Adherent |
| IGROV1 | Human | Ovary | Adherent |
| OVCAR-3 | Human | Ovary | Adherent |
| OVCAR-4 | Human | Ovary | Adherent |
| OVCAR-5 | Human | Ovary | Adherent |
| OVCAR-8 | Human | Ovary | Adherent |
| SK-OV-3 | Human | Ovary | Adherent |
| NCI-ADR-RES | Human | Ovary | Adherent |
| DU145 | Human | Prostate | Adherent |
| PC-3 | Human | Prostate | Adherent |

Figure 2:
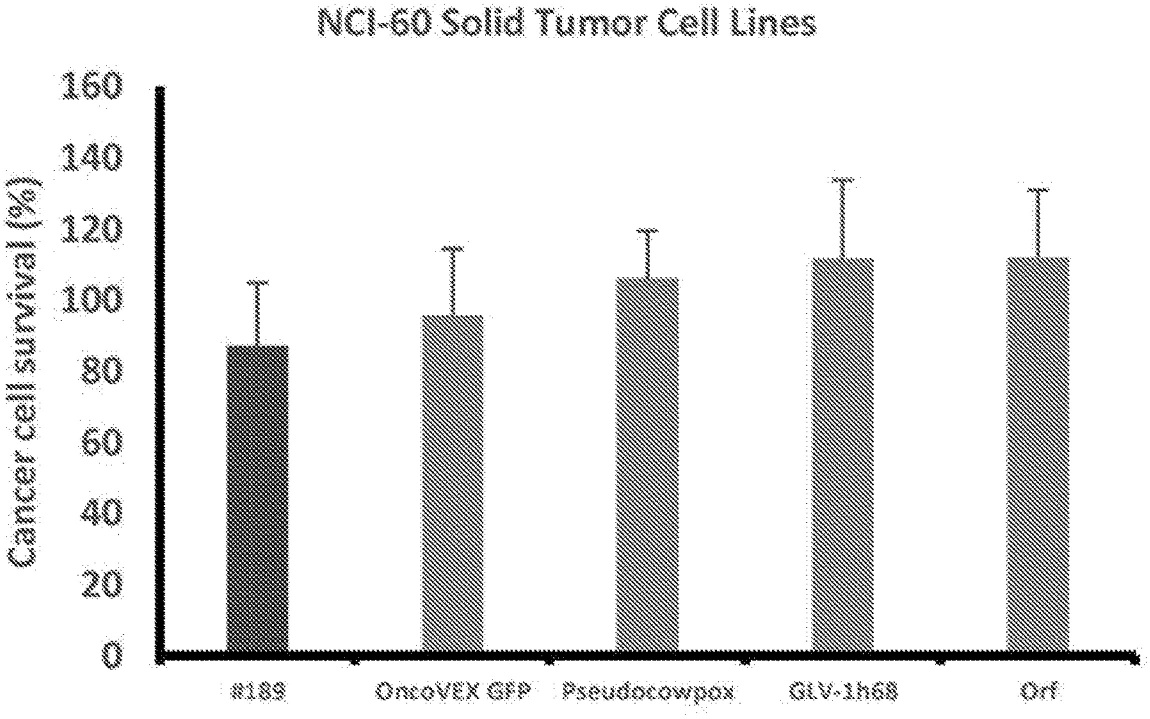
FIG. 2. Novel chimeric parapoxivirus isolate #189 (SEQ ID NO:2) shows superior cancer cell killing capability compared to the parental individual wild-type virus strains and the control viruses GLV-1h68 and OncoVEX GFP.

Among 100 new chimeric orthopoxvirus isolates, isolates #17 (SEQ ID NO:3) and #33 (SEQ ID NO:1) demonstrated significantly better cell killing in the NCI-60 solid tumor cell lines than did 9 parental orthopoxvirus strains and two control viruses (FIG. 1). Out of 100 new parapoxvirus isolates, isolate #189 (SEQ ID NO:2) stood out, showing the significantly better cell killing than did two parent parapoxvirus strains and the control viruses (FIG. 2). All three novel chimeric virus isolates (#17, #33, and #189) caused significant cell death in the majority of the NCI-60 solid cancer cell lines even at the low MOI of 0.01. In general, orthopoxvirus strains and chimeric orthopoxvirus isolates were more potent than parapoxvirus strains and chimeric parapoxvirus isolates in killing cancer cells at the low MOI of 0.01.

Genomic sequencing of #33 and #189. Genomic DNAs of novel poxvirus isolates #33 and #189 were isolated from purified virions and subject to next-generation sequencing using Illumina Hiseq 2500 with more than 1000× coverage. The gaps were PCR amplified and sequenced by Sanger sequencing. 189,415 base pairs (bps) of the #33 genome were fully sequenced whereas 138,203 bps of the 189 genome were obtained. Initial BLAST against GenBank indicated that the genomic sequences of both #33 and #189 are not identical to any genomic sequences in GenBank. #33 is more close to vaccinia virus strains than to any other orthpoxvirses. #189 is very close to orf virus NZ2 strain, one of the parental parapoxviruses. The nucleotide sequences of all ORFs identified in the orf virus NZ2 strain are identical to that in #189. There is one "G" insertion at position 6755 in the genome of #189 compared to orf virus NZ2. In the inverted terminal repeat regions there are one copy of a repeat element deleted and one copy of another repeat element inserted in the #189 genome. Overall, both #33 and #189 represent novel unique poxvirus isolates.

Methods and materials: Cell lines: All cancer cell lines were grown in RPMI-1640 (Mediatech, Manassas, VA). African green monkey kidney fibroblast cells (CV-1) and cow kidney epithelial cells (MDBK) were obtained from American Type Culture Collection (ATCC; Rockville, MD, USA) and grown in DMEM (Mediatech, Manassas, VA). All media were supplemented with 10% FBS (Mediatech, Manassas, VA) and 1% penicillin-streptomycin solution (Mediatech, Manassas, VA). Cells were cultured at 37° C. under 5% $CO_2$.

Viruses: cowpox virus strain Brighton, raccoonpox virus strain Herman, rabbitpox virus strain Utrecht, vaccinia virus strains WR, IHD, Elstree, CL, Lederle-Chorioallantoic and AS, orf virus strain NZ2 and pseudocowpox virus strain TJS were purchased from ATCC. All orthopoxvirus strains were grown and titrated in CV-1 cells were parapoxvirus strains were grown and titrated in MDBK cells.

Generation of chimeric orthopoxvirus and chimeric parapoxvirus pools and isolation of individual clonal chimeric virus isolates: A pool of chimeric orthopoxviruses was generated by co-infecting CV-1 cells with cowpox virus strain Brighton, raccoonpox virus strain Herman, rabbitpox virus strain Utrecht, and vaccinia virus strains WR, IHD, Elstree, CL, Lederle-Chorioallantoic and AS at a multiplicity of infection (MOI) of 0.01 per virus. To generate a pool of chimeric parapoxviruses, MDBK cells were co-infected with orf virus strain NZ2 and pseudocowpox virus strain TJS at an MOI of 0.1. Infected cells were harvested at 3 days after infection. The initial chimeric orthopoxvirus pool was further passaged for three times in CV-1 cell at an MOI of 0.1 where the initial chimeric parapoxvirus poos was further passaged for three times in MDBK cells at an MOI of 0.1. 100 chimeric orthopoxvirus plaques and 100 chimeric parapoxvirus plaques were picked from CV-1 cells infected with the final chimeric orthopoxvirus pool and MDBK cells infected with the final chimeric parapoxvirus pool, respectively. These two hundred plaques were further plaque-purified two more times in respective cells to yield 200 clonally purified individual chimeric virus isolates.

High throughput screening: NCI-60 cancer cell lines and a panel of pancreatic cancer cell line including PANC-1, MIA-PaCa2, BxPC3, FG, Capan-2 and Su.86.86 were dispensed into 96-well plates (3000 cells/well for solid tumor cell lines and 5000/well for leukemia cell lines) using an EPMOTION™ 5075 liquid handler (Eppendorf) under a sterile condition, incubated overnight at 37° C. under 5% (v/v) $CO_2$. Cells were then infected with 200 chimeric orthopoxvirus and chimeric parapoxvirus isolates, together with 11 parental virus strains and 2 control oncolytic viruses GLV-1h68 and OncoVEX GFP at an MOI of 0.01. Cell viability was determined at 96 h post infection using MTS assays (Promega). Absorbance at 490 nm was measured using an automated BMG PHERASTAR' plate reader (BMG Labtech). Each experiment was performed in duplicate. Cell viability for mock-infected cells was set to 100%.

Viral Cytotoxicity in gastric cancer cell lines: MKN-45, OCUM-2M and KATO-3 cells were seeded into 96-well plates at a concentration of 3,000 cells per well, and incubated overnight at 37° C. under 5% (v/v) $CO_2$. Cells were infected with #33, #189, GLV-1h68 and OncoVEX GFP at MOIs of 0.01, 0.1 and 1. Cell viability was monitored daily for 4 days using MTS assays. 37° C. under 5% (v/v) $CO_2$.

Genomic Sequencing: Genomic DNAs of #33 and #189 were extracted from purified virions using WIZARD™ Genomic DNA Purification kit (Promega) and fragmented by sonication. Libraries were prepared using KAPA LTP Library Preparation Kit. Sequencing was done using Illumina Hiseq 2500

Example 2. High Throughput Screening in Pancreatic Cancer Cell Lines

Figure 3:
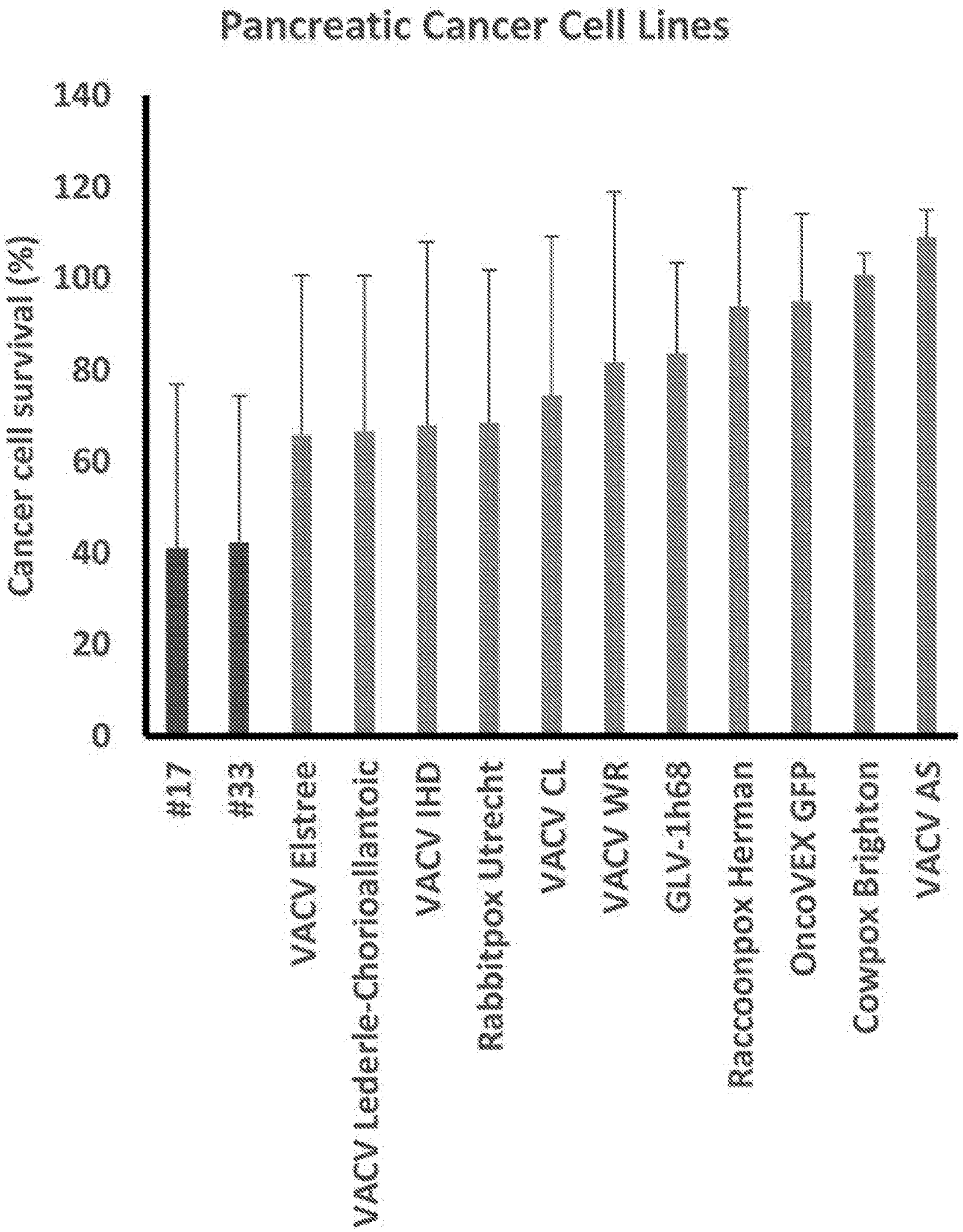
FIG. 3. Novel chimeric orthopoxvirus isolates #17 (SEQ ID NO:3) and #33 (SEQ ID NO:1) show potent cancer cell killing capacity in pancreatic cancer cell lines compared to their parent virus strains and the control viruses GLV-1h68 and OncoVEX GFP.
Figure 4:
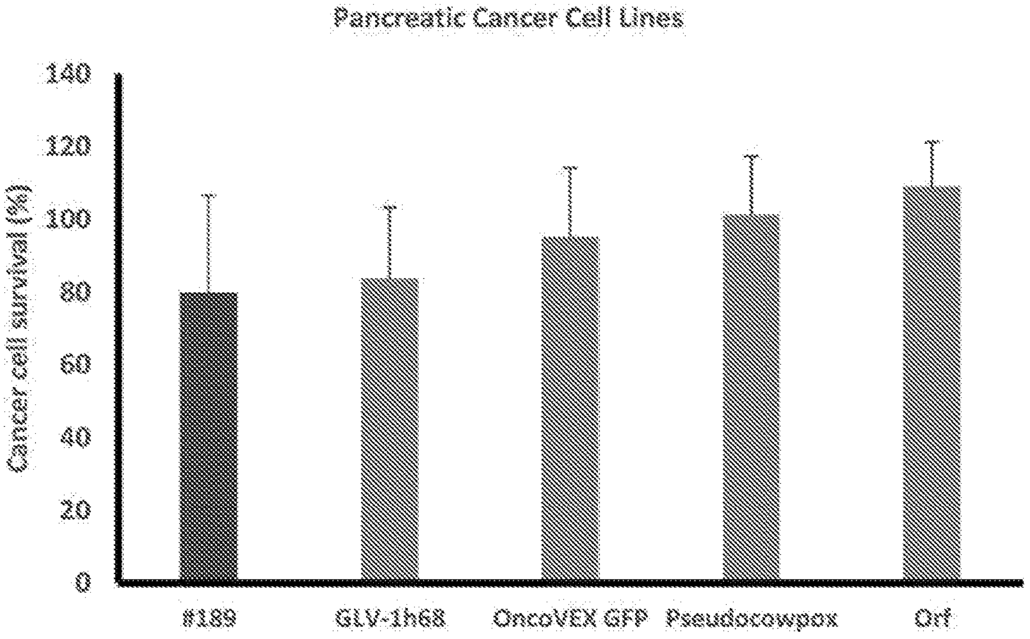
FIG. 4. Novel chimeric parapoxvirus isolate #189 (SEQ ID NO:2) shows potent cancer cell killing capability in pancreatic cancer cell lines compared to its parent virus strains and the control viruses GLV-1h68 and OncoVEX GFP.

NCI-60 cancer cell lines only contain solid cancers from 8 different organs (see Table 1). To investigate if the results from the NCI-60 cancer cell lines would be reproduced in solid cancers from other organs. Six pancreatic cancer cell lines (BxPC3, FG, MIA PaCa-2, Capan-2, PANC-1, and SU.86.86) were infected at an MOI of 0.1 with the same viruses used in the high throughput screening in the NCI-60 cancer cell lines. Cell viability was again measured at 96 h post infection using MTS assays. Chimeric orthopoxvirus isolates #17 and #33 showed the best cell killing among all the chimeric orthopoxvirus isolates whereas the chimeric parapoxvirus isolate #189 demonstrated the best cell killing among all the chimeric parapoxvirus isolates. They were all better in killing pancreatic cancer cell lines, as shown in Table 2 and FIG. 3 and FIG. 4, than their respective parent virus strains and the control viruses GLV-1h68 and OncoVEX GFP. Thus, the results from the NCI-60 cancer cell lines were very well reproduced in a panel of pancreatic cancer cell lines.

TABLE 2

Pancreatic Cancer Cell Survival. (VACV = vaccinia virus)

| BxPC3 Ave. | FG Ave. | MIA PaCa 2 Ave. | Capan 2 Ave. | PANC-1 Ave. | SU.86.86 Ave. | Ave. | stdev | Virus Name |
|---|---|---|---|---|---|---|---|---|
| 20.38 | 18.22 | 24.06 | 109.76 | 20.31 | 52.27 | 40.83 | 36.09 | #17 |
| 4.46 | 26.75 | 52.88 | 85.75 | 13.93 | 69.41 | 42.20 | 32.29 | #33 |
| 31.01 | 60.98 | 102.04 | 113.08 | 57.20 | 30.54 | 65.81 | 34.93 | VACV Elstree |
| 20.78 | 40.62 | 104.90 | 104.86 | 68.57 | 60.23 | 66.66 | 33.91 | VACV Lederle-Chorioallantoic |
| 18.21 | 33.81 | 93.44 | 106.36 | 45.64 | 109.87 | 67.89 | 40.05 | VACV IHD |
| 16.40 | 66.23 | 90.91 | 93.81 | 43.05 | 100.69 | 68.51 | 33.31 | Rabbitpox Utrecht |
| 19.57 | 50.96 | 97.52 | 108.60 | 68.27 | 101.81 | 74.46 | 34.78 | VACV CL |
| 17.51 | 75.42 | 102.31 | 123.05 | 68.27 | 103.55 | 81.69 | 37.29 | VACV WR |
| 50.01 | 79.85 | 89.31 | 97.55 | 78.14 | 106.86 | 83.62 | 19.70 | GLV-1h68 |
| 61.29 | 96.76 | 122.32 | 112.34 | 62.99 | 107.42 | 93.85 | 25.91 | Raccoonpox Herman |
| 63.81 | 99.06 | 114.44 | 80.60 | 108.15 | 104.16 | 95.04 | 19.14 | OncoVEX GFP |
| 106.79 | 95.12 | 101.38 | 102.37 | 95.09 | 103.55 | 100.71 | 4.71 | Cowpox Brighton |
| 101.00 | 106.93 | 118.90 | 111.92 | 107.05 | 108.34 | 109.02 | 5.99 | VACV AS |

Figure 5A:
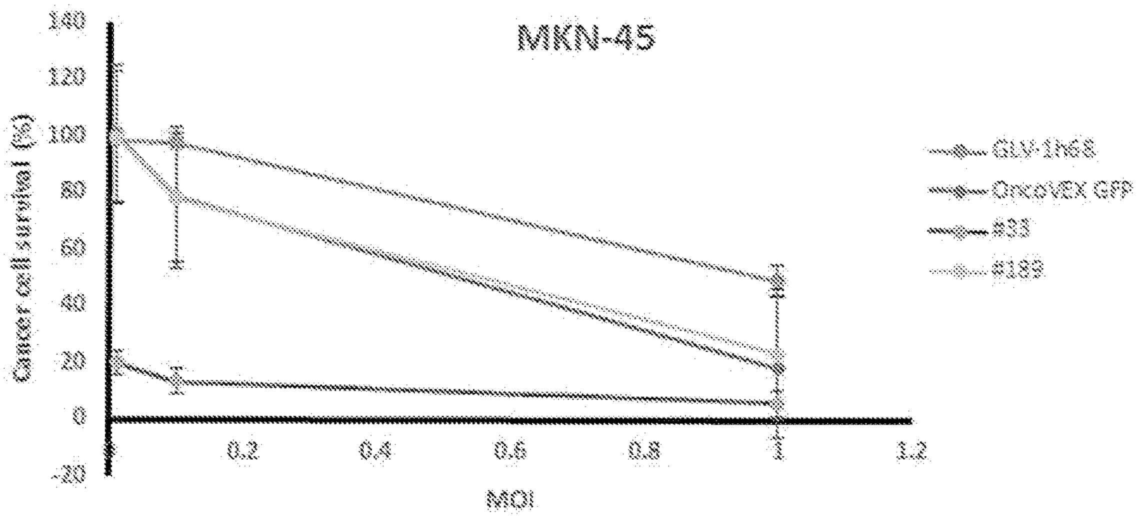
FIGS. 5A-5C. Novel chimeric virus isolates #33 (SEQ ID NO:1) and #189 (SEQ ID NO:2) show superior cell killing activity in gastric cancer cell lines. Cancer cells were infected with each virus at MOIs of 0.01, 0.1, and 1.0. Cell viabilities at 96 hours post infection were plotted agains MOIs in MKN-45 (FIG. 5A), OCUM-2M (FIG. 5B), and KATO-3 (FIG. 5C) gastric cell lines.
Figure 5B:
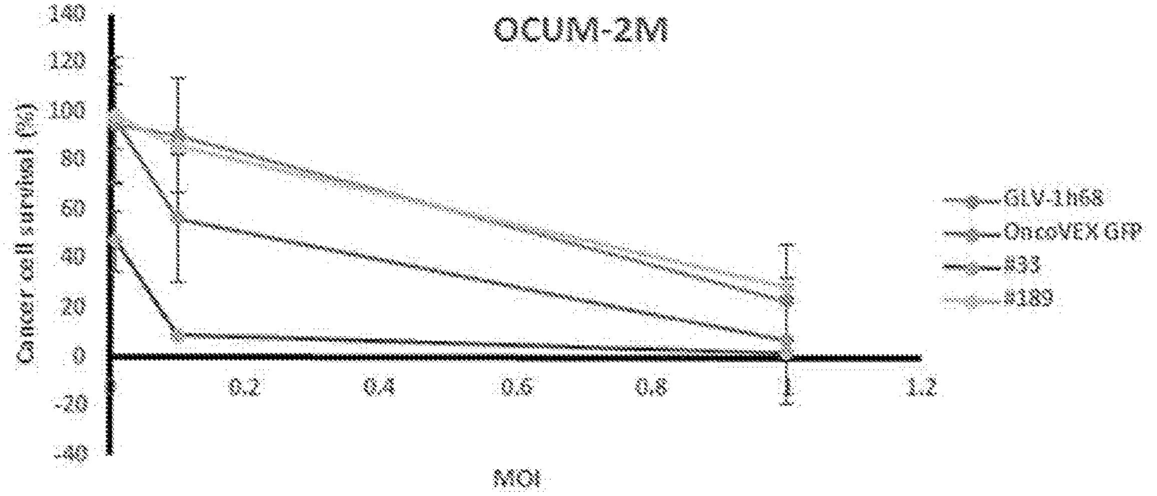
Figure 5C:
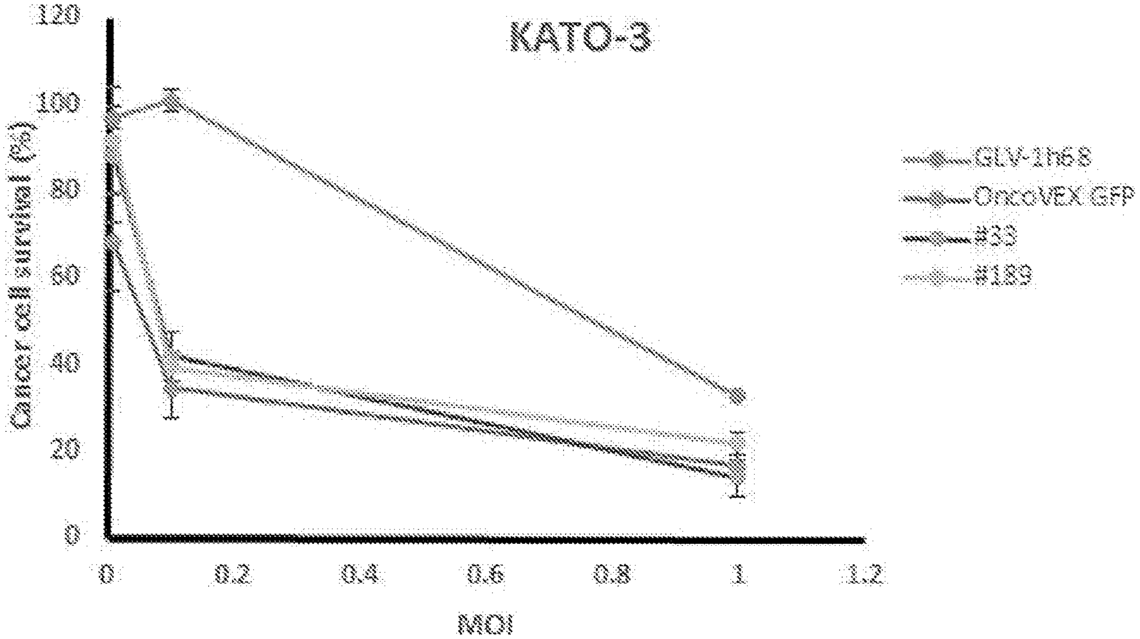

Example 3. Novel Chimeric Orthopoxvirus Isolate #33 and Chimeric Parapoxvirus Isolate #189 Show Potent Cell Killing in Gastric Cancer Cell Lines Based on the high throughput screening results from the NCI-60 cancer cell lines and the panel of pancreatic cancer cell lines, novel chimeric orthopoxvirus isolate #33 and chimeric parapoxvirus isolate #189 were chosen for further characterization. Tumor cell killing activity of the isolates #33 and #189 were further investigated in three gastric cancer cell lines. MKN-45, OCUM-2M and KATO-3 cells were infected with #33, #189, GLV-1h68 and OncoVEX GFP at MOIs of 0.01, 0.1 and 1. Cell viability was monitored daily for 4 days using MTS assays. MKN-45 and OCUM-2M cell lines were most sensitive to #33, intermediately sensitive to OncoVEX GFP, and least sensitive to GLV-1h68. While KATO-3 was most sensitive to OncoVEX GFP at the low MOI of 0.01, #33, #189, and OncoVEX GFP killed KATO-3 cells equally well at higher MOIs (0.1 and 1). KATO-3 cells were least sensitive to GLV-1h68. Overall, #33 killed gastric cancer cell lines most efficiently while GLV-1h68 kill gastric cancer cell lines lest efficiently (FIGS. 5A-5C).

The 90 genes that are present in all sequenced ChPVs are listed together with their function when known, as reported in Table 3. Genes are named after their VACV-COP counterpart. The asterisk, *, indicate genes also present in the two EnPVs. Table 3 is adapted from Gubser et al. (Gubser, C., Hue, S., Kellam, P., and Smith, G. L. (2004). Poxvirus genomes: a phylogenetic analysis. J Gen Virol 85, 105-117) and which is incorporated herein by reference in entirety and for all purposes.

TABLE 3

Minimal Gene Complement of Chordopoxviruses.

| ORF | Putative function | ORF | Putative function |
|---|---|---|---|
| F9L* | Unknown | H6R* | DNA topoisomerase I |
| F10L* | IMV serine-threonine protein kinase | H7R | Unknown |
| F12L | IEV protein | D1R* | mRNA capping enzyme, large subunit |
| F13L | EEV protein/phospholipase | D2L | IMV core protein |
| F15L | Unknown | D3R* | IMV core protein |
| F17R | IMV core phosphoprotein, VP11/DNA-binding protein | D4R* | Uracil-DNA glycosylase |
| E1L* | Poly(A) polymerase catalytic subunit | D5R* | Nucleoside triphosphatase |
| E2L | Unknown | D6R* | Early transcription factor small subunit, VETF-1 |
| E4L | Poly(A) polymerase catalytic subunit, rpo30/VITF-1 | D7R* | RNA polymerase subunit rpo18 |
| E6R* | Unknown | D9R | 29 kDa mutT-like protein |
| E8R | Unknown | D10R* | 29 kDa mutT-like protein, negative regulator of gene expression |
| E9L | DNA polymerase | D11L* | Nucleoside triphosphate phosphohydrolase I |
| E10R | IMV membrane-associated protein | D12L* | mRNA capping enzyme small subunit, intermediate transcription factor, VITF |
| I1L | IMV core/DNA-binding protein | D13L* | IMV protein, rifampicin resistance |
| I2L | Unknown | A1L* | Late transcription factor/VLTF-2 |
| I3L | Phosphoprotein, binds ssDNA | A2L* | Late transcription factor/VLTF-3 |
| I5L | IMV structural protein, VP13K | A2-5L | Thioredoxin-like protein |
| I6L | Unknown | A3L* | IMV major core protein, P4b |
| I7L* | IMV core protein | A4L | IMV core protein |
| I8R* | Nucleoside triphosphate phosphohydrolase II, RNA helicase, NTPase | A5R* | RNA polymerase subunit rpo19 |
| G1L* | Metallo-endoproteinase/virion morphogenesis | A6L | Unknown |
| G2R | Late transcription/IBT-dependent protein | A7L* | Early transcription factor large subunit, VETF |
| G3L | Unknown | A8R | Intermediate transcription factor, VITF-3 |
| G4L | Glutaredoxin 2, membrane protein, virion morphogenesis | A9L* | IMV protein, role in morphogenesis |
| G5R* | Unknown | A10L* | IMV major core protein P4a |
| G5-5R | RNA polymerase subunit rpo7 | A11R* | Unknown |
| G6R* | Unknown | A12L | IMV core protein |
| G7L | IMV core protein, VP16K | A13L | IMV membrane-associated protein/p8 |
| G8R | Late transcription factor, VLTF-1 | A14L | IMV protein, p16 |
| G9R* | Myristyl protein | A14-5L | IMV protein |
| L1R* | Myristylated IMV protein | A15L | Unknown |
| L2R | Unknown | A16L* | Myristyl protein |
| L3L* | Unknown | A17L | IMV membrane protein, morphogenesis factor |
| L4R* | IMV core protein VP8, DNA and RNA-binding protein | A18R* | DNA helicase, DNA-dependent ATPase, transcript release factor |
| L5R* | Unknown | A19L | Unknown |
| J1R | Dimeric virion protein | A20R | DNA polymerase processivity factor |
| J3R* | Poly(A) polymerase stimulatory submit, VP39 | A21L* | Unknown |
| J4R | RNA polymerase subunit rpo22 | A22R* | Holiday junction resolvase |
| J5L* | Unknown | A23R* | Intermediate transcription factor, VITF-3 |
| J6R* | RNA polymerase subunit rpo147 | A24R* | RNA polymerase subunit rpo132 |
| H1L | Tyrosine-serine phosphatase, virion maturation | A28L* | Unknown |

TABLE 3-continued

| Minimal Gene Complement of Chordopoxviruses. | | | |
|---|---|---|---|
| ORF | Putative function | ORF | Putative function |
| H2R* | Unknown | A29L* | RNA polymerase subunit rpo35 |
| H3L* | Immunodominant IMV envelope protein p35 | A30L | Unknown |
| H4L* | RNA polymerase-associated transcription specificity factor, RAP 94 | A32L* | ATP- and GTP-binding motif A, DNA packaging |
| H5R | Late transcription factor, VLTF-4 | A34R | EEV glycoprotein |

Abbreviations:
IMV, intracellular mature virus;
IEV, intracellular enveloped virus;
EEV, extracellular enveloped virus It is understood that the examples and embodiments described herein are for illustrative purposes only and that various modifications or changes in light thereof will be suggested to persons skilled in the art and are to be included within the spirit and purview of this application and scope of the appended claims. All publications, patents, and patent applications cited herein are hereby incorporated by reference in their entirety for all purposes.

Example 4. Novel Chimeric Parapoxvirus HOV-189 as an Oncolytic Immunotherapy in Triple-Negative Breast Cancer Triple-negative breast cancer (TNBC) is an aggressive subtype of breast cancer with high recurrence rate and poor prognosis. Here Applicants describe a novel, genetically engineered parapoxvirus that efficiently kills TNBC.

Methods: A novel chimeric parapoxvirus (HOV-189) was generated via homologous recombination and identified through high-throughput screening. Cytotoxicity was assayed in vitro in four TNBC cell lines. Viral replication was examined through standard plaque assay. Orthotopic TNBC xenografts were generated by MDA-MB-468 implantation into the second and fourth mammary fat pads of athymic nude mice, and treated with virus.

Results: HOV-189 demonstrated dose-dependent cytotoxicity at low multiplicity of infection (MOI), with >90% cell death six days after treatment. Significant reductions in tumor size were observed two weeks after intratumoral injection at doses as low as $10^3$ PFU compared to control ($P<0.01$). In addition, abscopal effect (shrinkage of non-injected remote tumors) was clearly demonstrated.

Conclusion: HOV-189 demonstrated efficient cytotoxicity in vitro and potent anti-tumor effect in vivo at doses as low as $10^3$ PFU. These are data encouraging of clinical development for this highly potent agent against TNBC.

Introduction

Approximately 12-20% of one million newly diagnosed breast cancer cases worldwide each year are triple-negative,[11] meaning they lack expression of the estrogen receptor (ER), progesterone receptor (PR) and human epidermal growth factor receptor 2 (HER2). Triple-negative breast cancer (TNBC) demonstrates poorer clinical outcomes, both due to its inherently aggressive behavior and the lack effective targeted therapies. Patients with TNBC are at higher risk of relapse and development of metastatic disease in the first five years following diagnosis than non-TNBC patients.[12]

Currently, the mainstay of adjuvant therapy for TNBC is cytotoxic chemotherapy, but there has been intensive research and development of targeted therapies, including studies on poly (ADP-ribose) polymerase 1 (PARP1) inhibitors, PI3K inhibitors, MEK inhibitors and programmed cell death ligand 1 (PD-L1) inhibitors.[11,13]

Immunotherapies have long been an area of investigation for many cancer types, including breast cancer. TNBC demonstrates increased genetic instability, higher rate of neoantigens, and has frequency of tumor infiltrating lymphocytes (TILs) in the microenvironment, making TNBC more immunogenic than non-triple negative disease.[14] These factors make TNBC a good candidate for immunotherapy. Applicants previously investigated an oncolytic vaccinia virus with antitumor effect in a TNBC model.[15] Here Applicants present data on a novel chimeric parapoxvirus that is effective in TNBC models both in vitro and in vivo.

Methods

Cell culture and cell lines. Human triple-negative breast cancer cell lines MDA-MB-231 (kindly provided by Dr. Sangkil Nam, City of Hope), MDA-MB-468 (kindly provided by Dr. John Yim, City of Hope), BT549 (Dr. Yim) and Hs578T (Dr. Yim) were cultured in RPMI 1640 (Corning, Corning NY) supplemented with 10% fetal bovine serum (FBS) and 100 IU/ml streptomycin and penicillin. All TNBC lines were tested and verified as authentic by Genetica Cell Line Testing (Burlington, NC). African green monkey kidney fibroblasts (CV-1) and MDBK cells were obtained from American Type Culture Collection (Manassas, VA) and cultured in Dulbecco's modified Eagle's medium (DMEM, Corning, Corning NY) supplemented with 10% FBS and 100 IU/ml streptomycin and penicillin. All cells were grown at 37° C. in a 5% $CO_2$-humidified incubator.

Development and selection of chimeric parapoxvirus. To generate a pool of chimeric parapoxviruses, MDBK cells were co-infected with orf virus strain NZ2 (ATCC) and pseudocowpox virus strain TJS (ATCC). Infected cells were harvested at three days after infection. One hundred chimeric parapoxvirus plaques were picked from MDBK cells infected with the chimeric parapoxvirus pool. These 100 plaques were further plaque-purified two more times in MDBK cells to yield 100 clonally purified individual chimeric virus isolates, which, together with its parental viruses, were subject to high throughput screening in the NCI-60 cell lines. The isolate HOV-189 that demonstrated the most potent tumoricidal properties against the NCI-60 cell lines was chosen for this study.

Cytotoxicity assays. Cells were seeded at 1000 cells/well for MDA-MB-231, BT549 and Hs578T and at 3000 cells/well for MDA-MB-468 in 96-well plates and incubated overnight. Cells were infected with 0.1, 1 and 10 MOI of each virus for MDA-MB-231 and with 0.01, 0.1 and 1 for MDA-MB-468, BT549 and Hs578T. Cell viability was measured in triplicate every 24 hours for one to six days using CELLTITER 96™ Aqueous One solution (Promega, Madison, WI) on a spectrophotometer (Tecan Spark 10M, Mannedorf, Switzerland) at 490 nm.

Viral replication assays. Viral replication in TNBC was quantified using standard plaque assay. Cells were plated to confluence in 6-well plates in 2 ml growth media, then infected with 0.01 MOI of each virus. Cells were harvested in triplicate for three consecutive days. MDBK cells were infected with serial dilutions of samples treated with HOV-189 in 24-well plates.

Orthotopic xenograft models. Twenty-six Hsd:Athymic Nude-Foxn1$^{nu}$ female nude mice (Envigo, Indianapolis, IN) were injected with $10^7$ MDA-MB-468 cells with 6 mg/ml matrigel (Corning) in the second and fourth mammary fat pads at 12 weeks of age. When the tumors reached approximately 100-150 $mm^3$ in size, mice were randomized and tumors were injected intratumorally with either PBS alone (n=4), $10^3$ PFU (n=6), $10^4$ PFU (n=6) or $10^5$ PFU (n=7) in 50 ul PBS. Variance of tumor size did not differ significantly between the groups prior to treatment. Tumor size was then measured every three days for six weeks. Tumor volume was calculated according to $V\ (mm^3)=(4/3)\times(\pi)\times(a/2)^2\times(b/2)$, where a is the smallest diameter and b is the largest diameter. Seven days following intratumoral injection, two to four mice per group were sacrificed such that tumor and organs (lung, heart, liver, kidney, spleen, ovary, brain) were snap frozen in liquid nitrogen and used for further histopathological staining, immunohistochemical staining and viral plaque assays. For the remaining three mice, only the second mammary tumors were treated with $10^5$ PFU in 50 ul PBS in order to observe the effect, if any, on the uninjected fourth mammary tumor. Two weeks after treatment, both tumors were harvested to determine viral titer in each.

Results

Figure 6A:
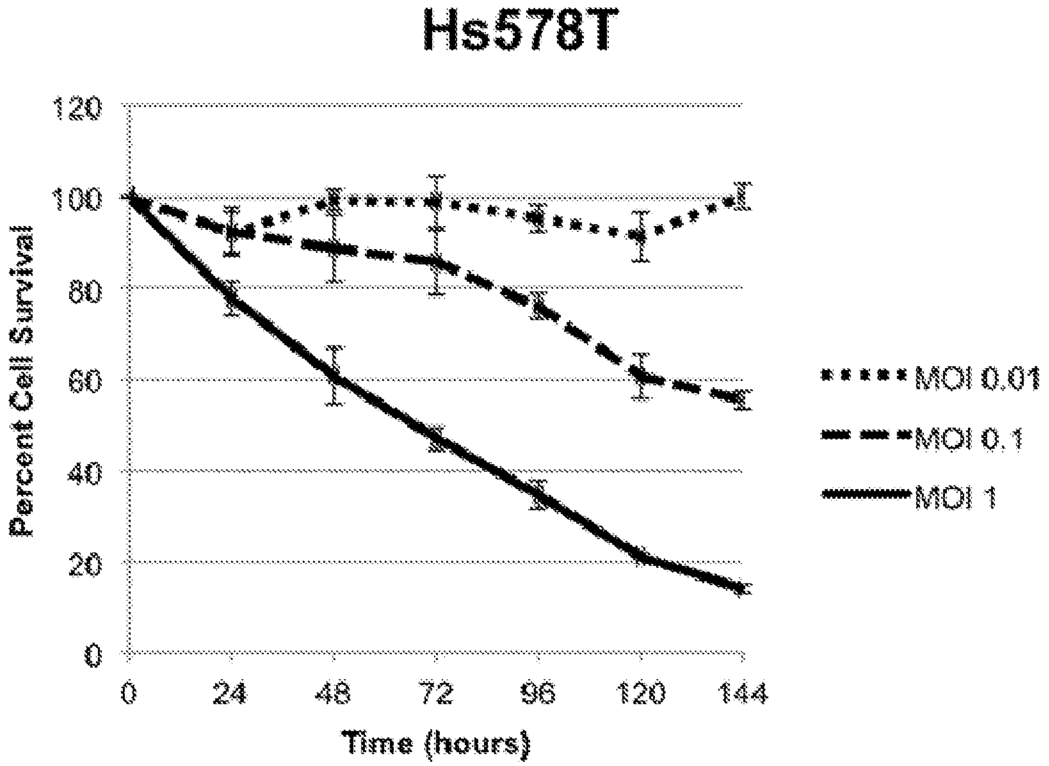
FIGS. 6A-6D. Cytotoxic effect of HOV-189 (SEQ ID NO:2) in vitro is both a time- and dose-dependent in triple-negative breast cancer cell lines.
Figure 6B:
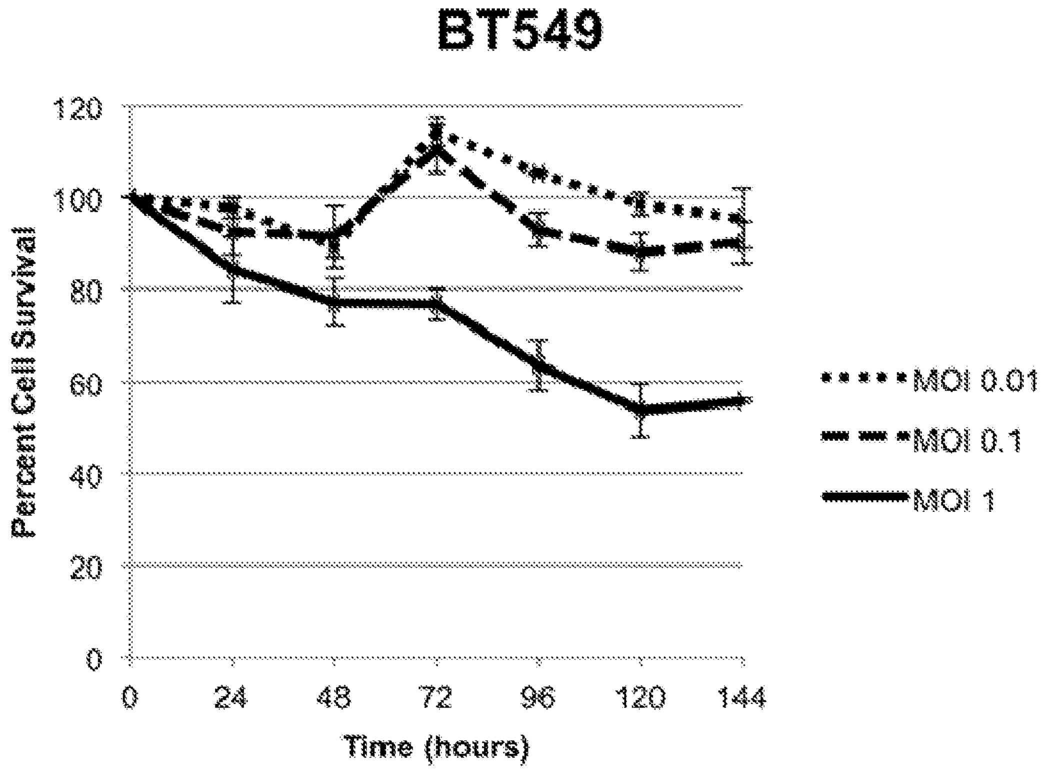
Figure 6C:
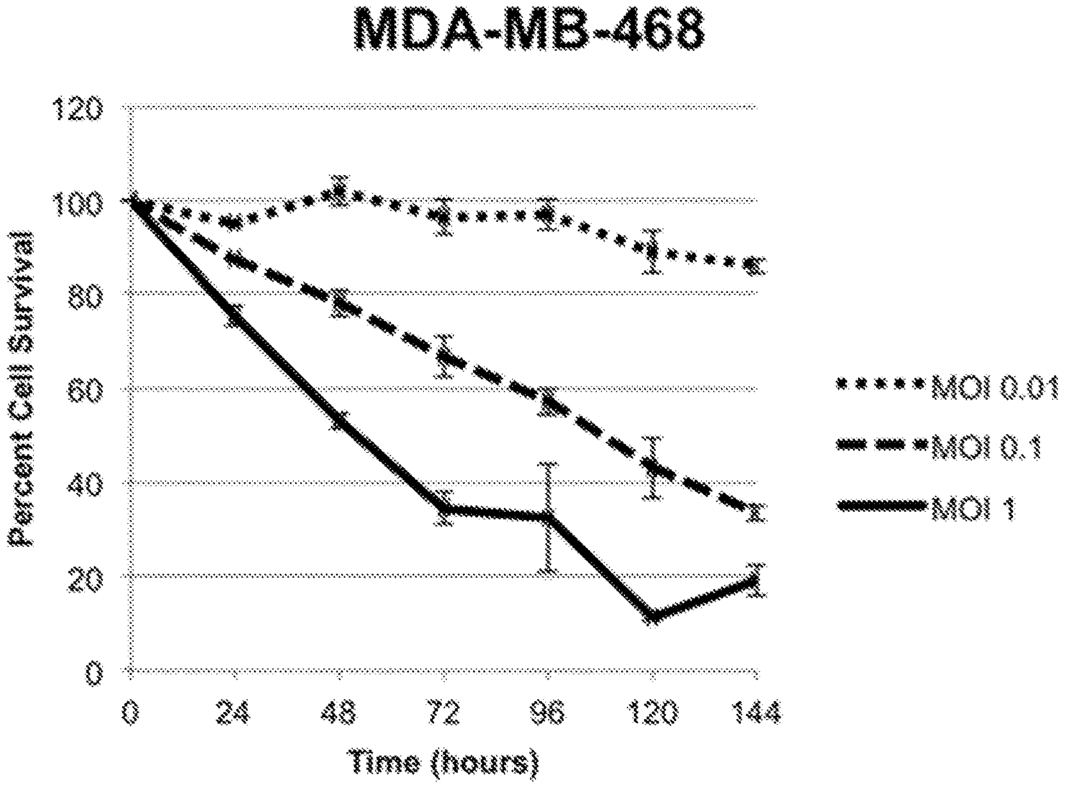
Figure 6D:
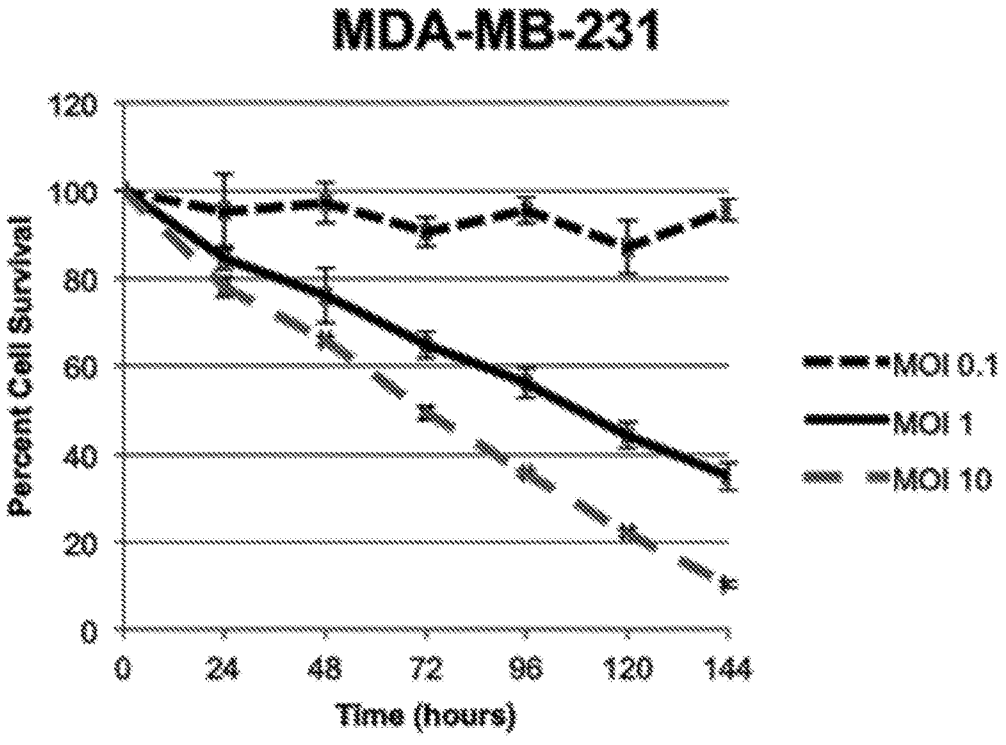

HOV-189 effectively kills TNBC in vitro in a time- and dose-dependent manner. Given the heterogeneous nature of TNBC, two cell lines of metastatic origin (MDA-MB-231 and MDA-MB-468) and two cell lines of non-metastatic origin (Hs578T and BT549) were treated with HOV-189 at MOI ranging from 0.01 to 10 over six days. HOV-189 most efficiently killed Hs578T (LD50 at 96 hrs: MOI 0.396) and MDA-MB-468 (LD50, MOI 0.185) with >80% cell death at six days when treated with MOI 1 (FIGS. 6A and 6C). Although LD50 was higher for BT549 and MDA-MB-231 (LD50, MOI 1.636 and MOI 1.712, respectively), MDA-MB-231 data shows that increasing the concentration of HOV-189 results in >90% cell death at MOI 10 after six days (FIG. 6D).

Figure 7:
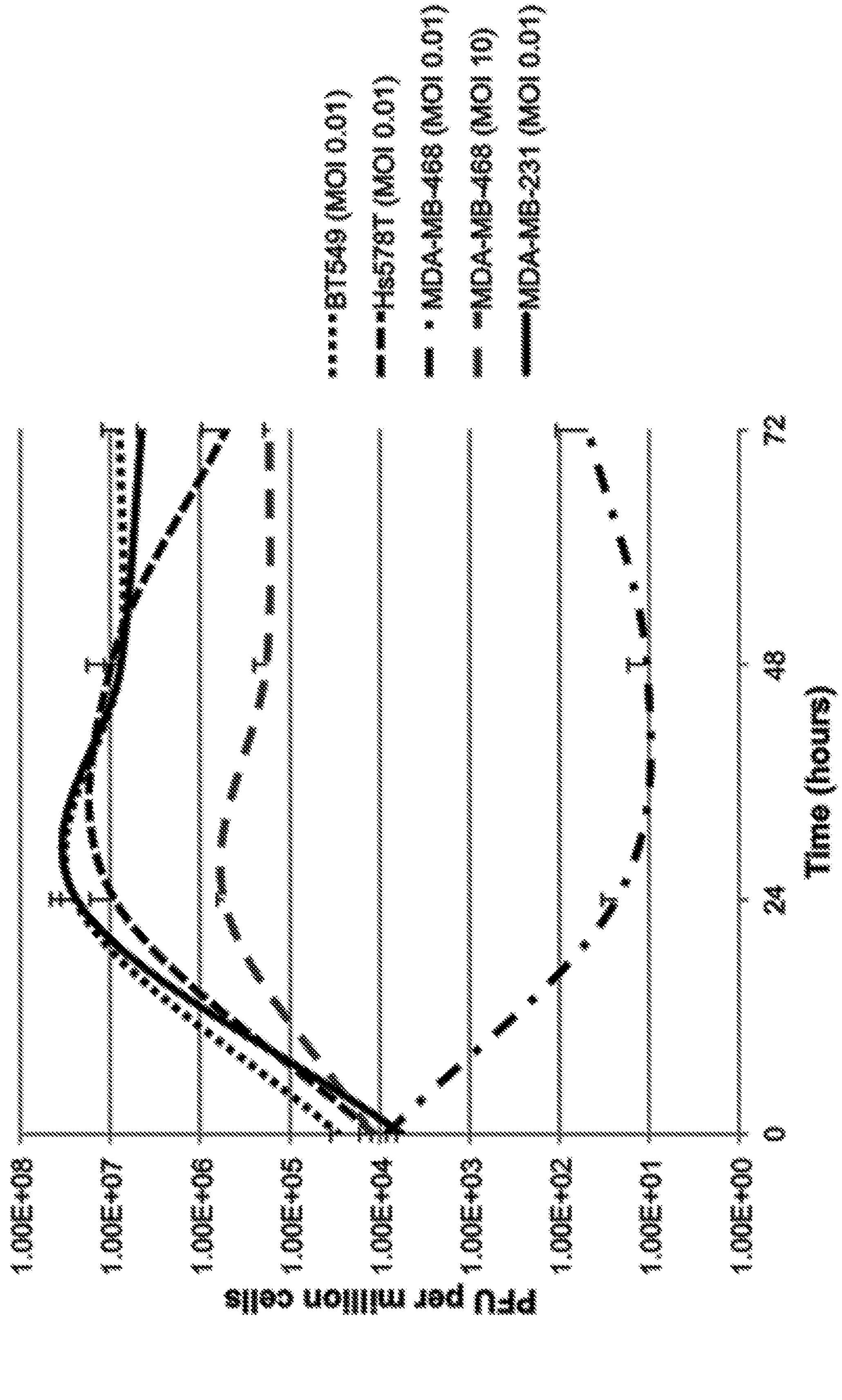
FIG. 7. Replication of HOV-189 (SEQ ID NO:2) in triple-negative breast cancer cell lines. Efficient viral replication occurred in vitro in BT549, Hs578T and MDA-MB-231 cell lines at low multiplicity of infection (MOI 0.01). HOV-189 replication in MDA-MB-468 was poor at MOI 0.01. At MOI 10, HOV-189 replication in MDA-MB-468 remained nearly two-log lower than the other three cell lines.

HOV-189 replicates in TNBC in vitro. Viral replication was assessed in all four TNBC cell lines by standard plaque assay of infected cells collected over three days. Efficient viral replication occurred in BT549, Hs578T and MDA-MB-231 at MOI 0.01, with maximal replication occurring in the 24-48 hour time period (FIG. 7). However, HOV-189 replication in MDA-MB-468 was poor at MOI 0.01 despite demonstrating effective cytotoxicity at low MOI. Viral replication was improved by increasing concentration to MOI 10 in the MDA-MB-468 line (FIG. 7).

Figure 8:
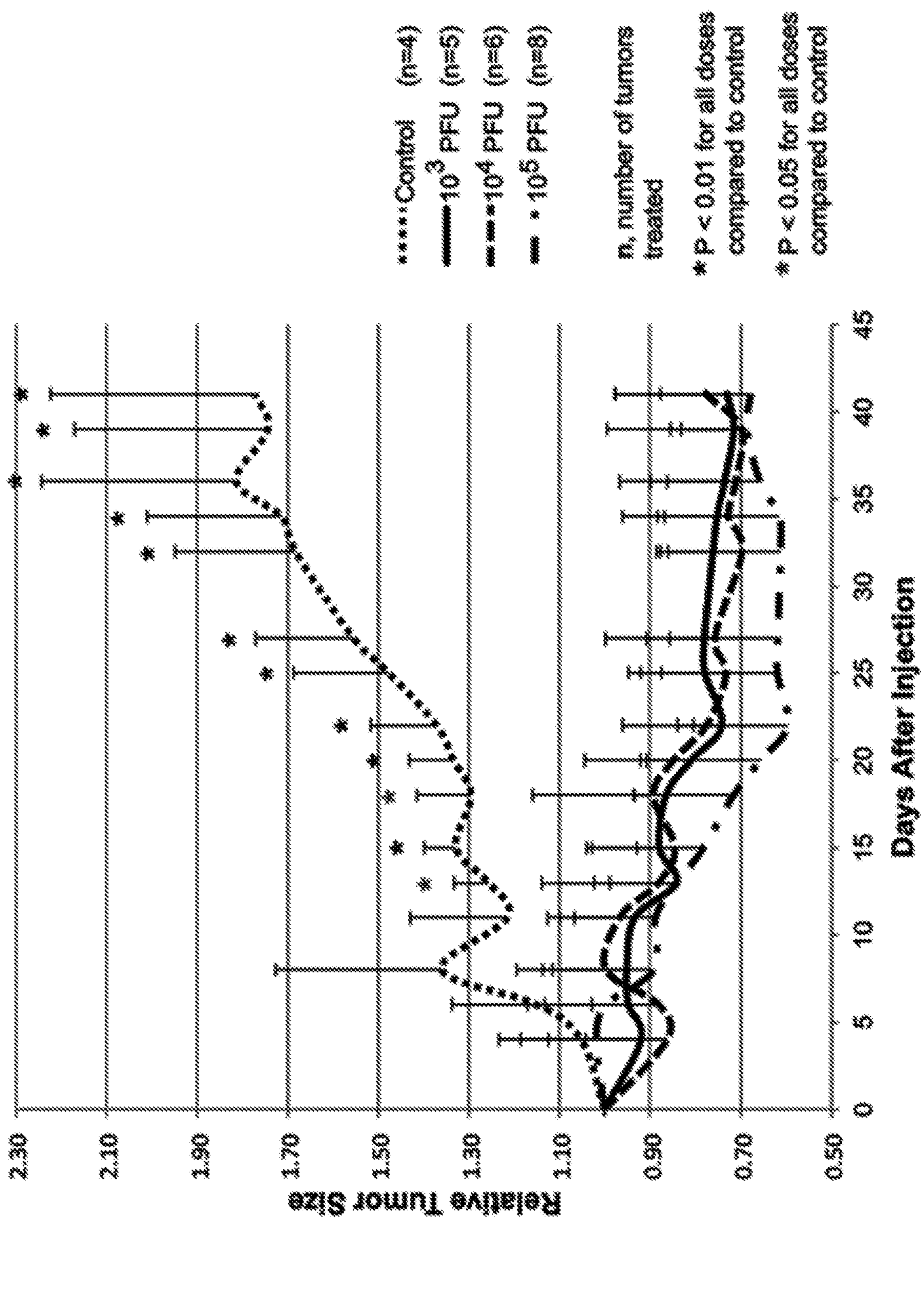
FIG. 8. Intratumoral injection of HOV-189 (SEQ ID NO:2) in MDA-MB-468 xenografts effectively reduces relative tumor size in doses as low as $10^3$ PFU per tumor compared to control. Tumors were injected with PBS (control), $10^3$ PFU per tumor, $10^4$ PFU per tumor or $10^5$ PFU per tumor at an initial tumor volume of approximately 100-150 $mm^3$. Tumor size was measured approximately every 3 days and treatment effect was sustained 6 weeks post-injection.
Figure 9:
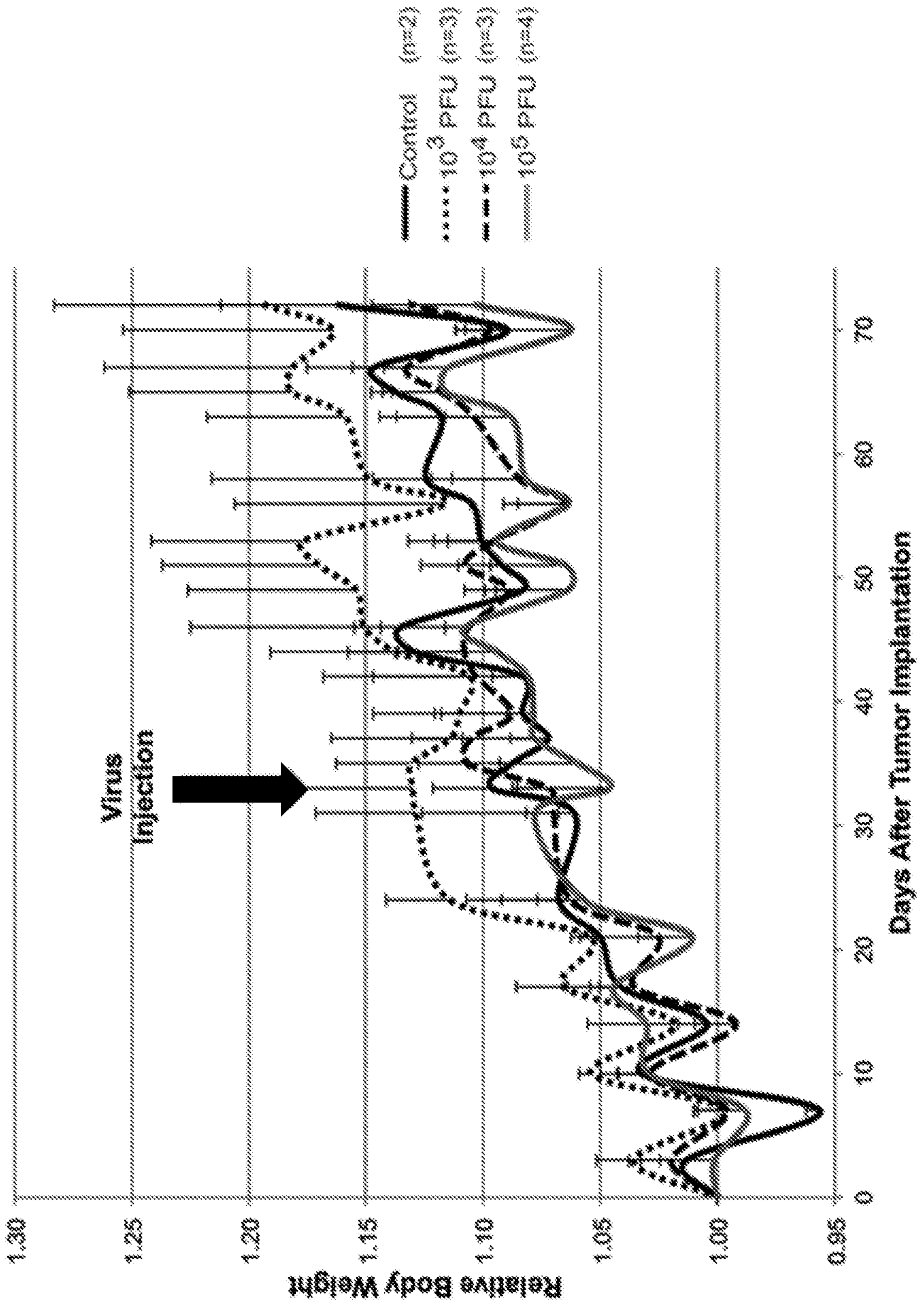
FIG. 9. No significant reductions in relative body weight are observed in nude mice treated with intratumoral HOV-189 (SEQ ID NO:2) injection compared to PBS-injected controls. Body weights were measured approximately every 3 days.

Intratumoral HOV-189 injection effectively reduces tumor size in orthotopic TNBC xenografts without significant viral toxicity. Orthotopic xenografts were created by implanting MDA-MB-468 cells into the second and fourth mammary fat pads of athymic nude mice. Both tumors received a single intratumoral injection of either PBS or HOV-189 ($10^3$ PFU, $10^4$ PFU, or $10^5$ PFU). All groups treated with HOV-189 demonstrated significant reduction in relative tumor size by post-treatment day 13 compared to PBS-treated controls and this treatment effect was sustained six weeks post-injection (FIG. 8). Intratumoral injections were well tolerated without notable viral toxicity in the mice, as demonstrated by lack of significant body weight reduction in treatment groups compared to controls (FIG. 9).

HOV-189 biodistribution at one week and six weeks post-treatment demonstrates inherent tumor-specificity in vivo. One week and six weeks after HOV-189 injection, two to four mice from each group were sacrificed for viral biodistribution. Viral titers of infected tumor tissue demonstrated 2-log higher HOV-189 titer compared to other organs at both time points, reflecting HOV-189's natural tropism for cancer cells compared to normal cells (Table 4). Apart from injected tumor tissue, HOV-189 was only detected in heart and lung tissue one week post-injection and in lung tissue six weeks post-injection, which correlates with the lack of significant systemic toxicity observed.

Figure 10A:
FIGS. 10A-10C. HOV-189 (SEQ ID NO:2) infects MDA-MB-468 tumors in vivo. Immunofluorescent detection of polyclonal antibody against ORF virus demonstrates viral infection of MDA-MB-468 xenograft tumor tissue harvested 1 week after intratumoral HOV-189 injection.
Figure 10B:
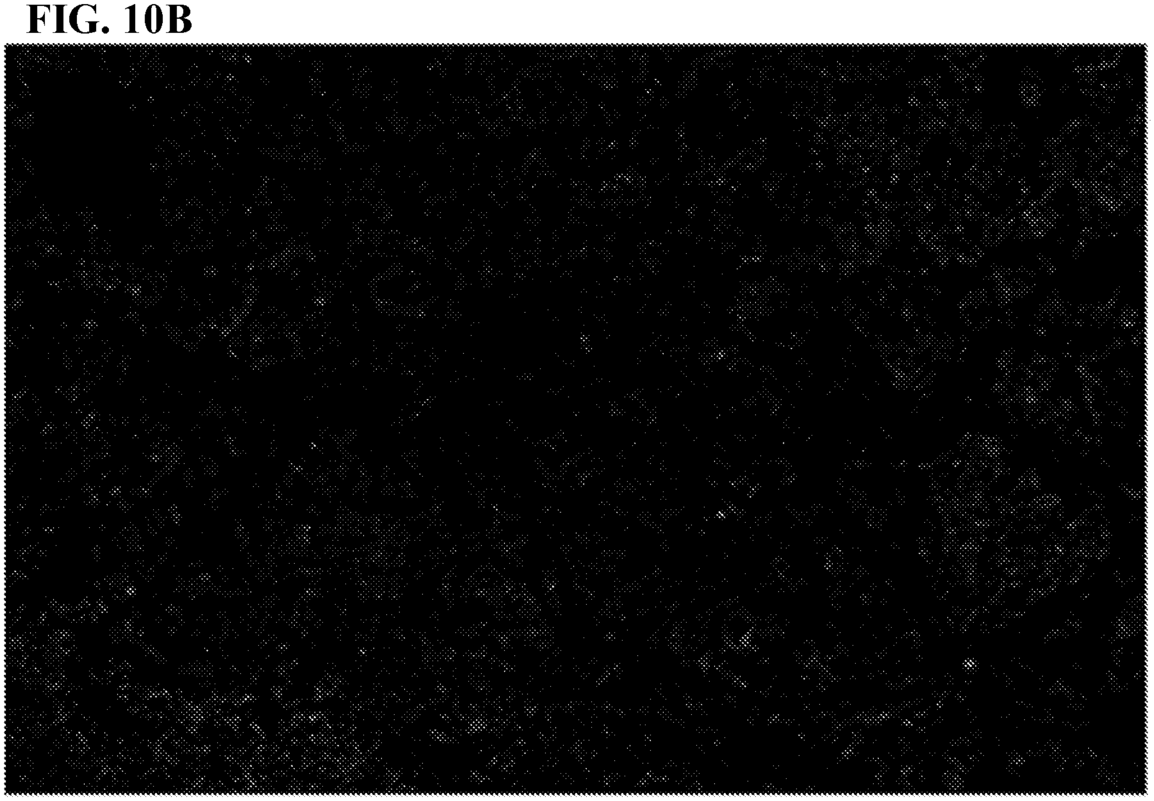
Figure 10C:
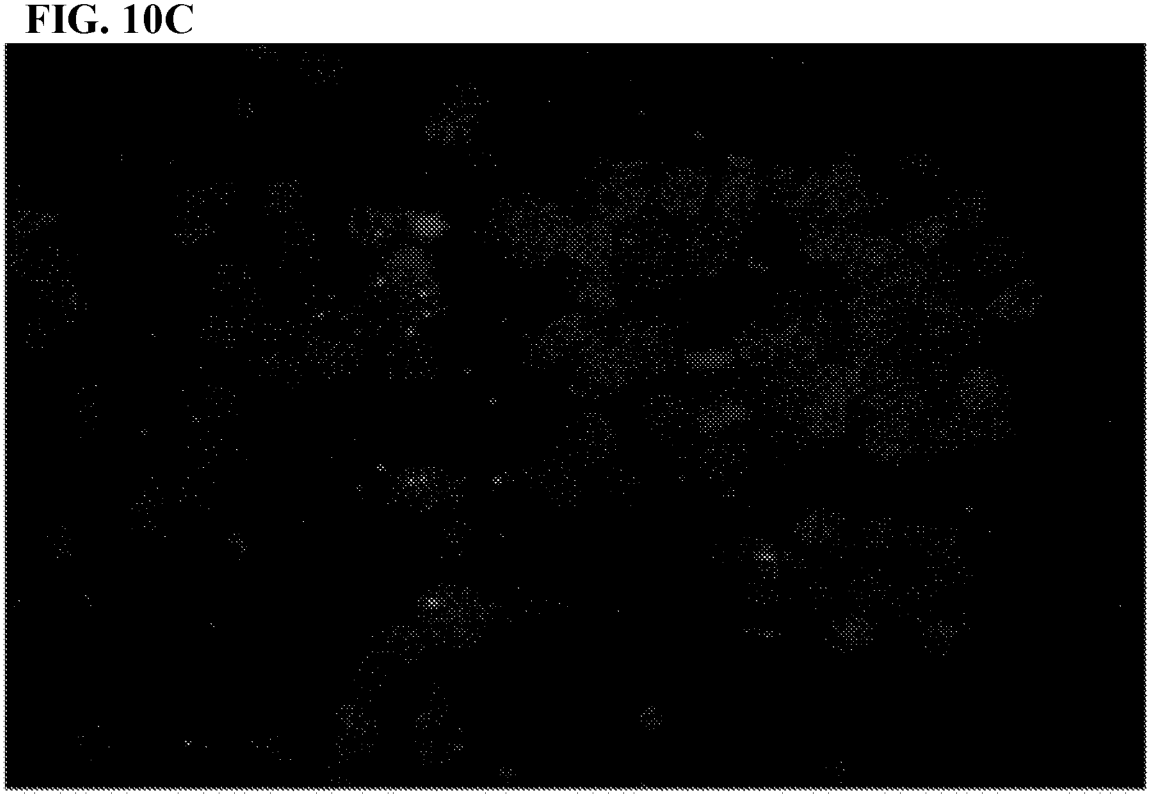

Infection and replication of HOV-189 in orthotopic xenograft model confirmed by immunofluorescent imaging. One week after HOV-189 injection, immunofluorescent detection of polyclonal antibody against orf virus demonstrates viral infection of tumor tissue treated with HOV-189 at $10^5$ PFU per tumor compared to control (FIGS. 10A and 10B). Furthermore, the pattern of antibody detection merged with DAPI counterstain is consistent with active replication in viral factories, as the orf virus antibodies localize to areas just outside the nucleus (FIG. 10C).

Figure 11:
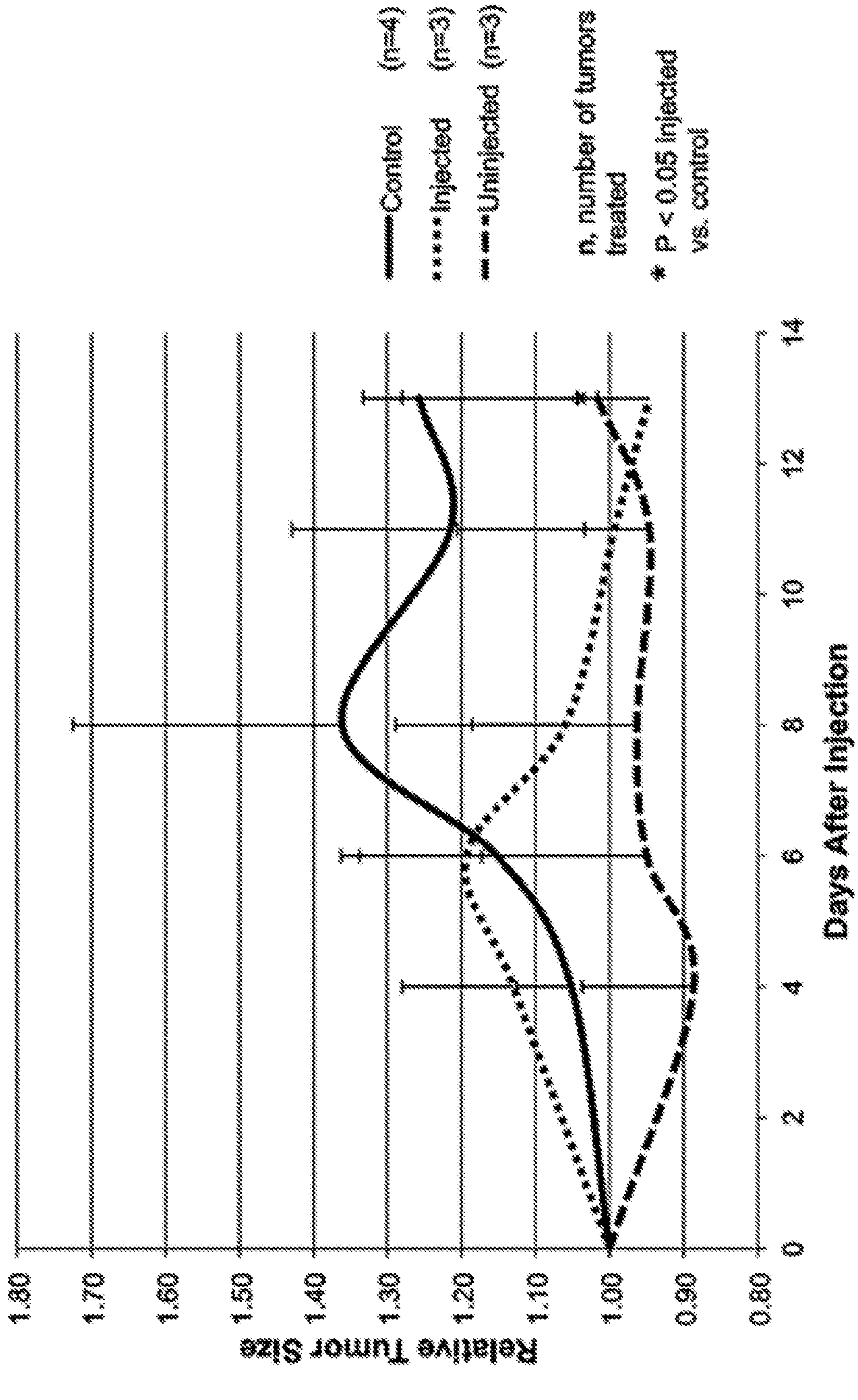
FIG. 11. Intratumoral HOV-189 (SEQ ID NO:2) injection produces tumoristatic effect on a distant uninjected tumor. Second mammary tumors produced in MDA-MB-468 xenografts were treated with a single intratumoral injection of HOV-189 at $10^5$ PFU, while the fourth mammary tumors were not injected. Control tumors were injected with PBS. Tumor size was measured approximately every 3 days.

Intratumoral HOV-189 injection produces tumoristatic effect on distant uninjected tumors. Three animals were treated with HOV-189 at $10^5$ PFU in only the second mammary tumor, while the fourth mammary tumor remained untreated. Tumor size was measured every three days in comparison to PBS-treated controls and viral titers were quantified by standard plaque assay at the end of two weeks. While relative tumor size increased initially in the injected tumor group (likely due to the trauma of the injection itself), tumor size decreased after day six with significant reduction compared to control by day 13 ($p<0.05$). Relative tumor size of the uninjected tumor group remained stable despite never being directly treated with HOV-189 (FIG. 11). Viral titers at the end of two weeks showed the average titer of injected tumors was $3.37\times10^3$ PFU/g tissue compared to the average of uninjected tumors at $1.15\times10^3$ PFU/g tissue.

Discussion

Triple-negative breast cancer (TNBC) accounts for 15-20% of all breast cancer diagnoses. It tends to exhibit aggressive biology, often affecting younger women and portending higher rates of recurrence and poorer overall survival.[16,17] In contrast to hormone receptor-positive disease, TNBC lacks known biologic markers for the development and administration of effective targeted therapies. Therefore, the mainstay of neoadjuvant and adjuvant therapies remains cytotoxic chemotherapy, which can be associated with numerous systemic side effects.[11,13]

In October 2015, the US Food and Drug Administration (FDA) approved a herpes simplex virus (HSV-1) named T-VEC (talimogene laherparepvec) as the first oncolytic virus (OV) for use in humans.[18] This approval was a landmark event in the fields of virology and immunotherapeutics, spurring great interest in further development of OVs for the treatments of other cancers, including TNBC. OVs demonstrate a natural tropism for cancer cells compared to normal cells, exploiting pathologic derangements in cancer cells such as altered intracellular signaling pathways and overexpression of cell surface receptors to preferentially infect cancer cells.[19-21] Additionally, OV-mediated destruction of infected cells releases cytokines, tumor-associated antigens (TAA), damage-associated molecular pattern molecules (DAMPs) and pathogen-associated molecular pattern (PAMPs) molecules that prime both the innate and adaptive immune systems against cancer cells.[20,22-26] TNBC demonstrates increased genetic instability, increased number of neoantigens, and increased number of tumor infiltrating lymphocytes (TILs) in the microenvironment.[14] This makes TNBC more immunogenic than non-triple negative disease and an appealing candidate for OV-directed therapy.

This study demonstrates that a novel chimeric parapoxvirus, HOV-189, has in vitro cytotoxic effects in four different TNBC cell lines, both of metastatic and non-metastatic origin. Single intratumor injection of HOV-189 in athymic nude mice TNBC xenografts significantly reduced tumor size without signs of significant toxicity. Furthermore, the virus was also detected at non-injected distant tumor sites with size stabilization of those tumors. Thus, HOV-189 demonstrates the ability to travel systemically and target distant sites of disease, which may have applications in neoadjuvant therapy and also in metastatic settings.

Of note, in vivo reduction of tumor size was observed with HOV-189 doses as low as $10^3$ PFU per tumor. This suggests that the antitumor effect is unlikely a result of direct oncolysis from viral replication, as HOV-189 demonstrated poor in vitro replication. Genetic sequencing of HOV-189 reveals close relationship to one of its parent viruses, the parapoxvirus orf virus (ORFV). Previous studies of ORFV have shown that ORFV treatment induces a strong immunomodulatory effect, particularly with regard to natural killer (NK) cell activation.[27,28] Even treatment with ultraviolet (UV)-inactivated ORFV elicited similar, although weaker, response, demonstrating that the virus itself likely harbors an antigenic structural component that is capable of inducing an immune response independent of its actual replication. Given that HOV-189's genetic sequence is very closely related to the ORFV NZ2 virus, Applicants hypothesize that HOV-189's antitumor mechanism of action is likely immune cell-mediated, perhaps NK-cell mediated, explaining the effect seen at low dose and its poor replication in vitro.

In comparison to other OVs, ORFV has not been well-studied in the context of clinical therapeutics development. Much of what is known with regard to its natural disease history has been gleaned from veterinary medicine. However, there are several properties of ORFV that may be advantageous for developing it as an OV for the treatment of human cancers. Firstly, ORVF infection does not cause serious diseases in humans.[29] Secondly, ORFV infection induces a potent immune system stimulation (Th1 dominated) and even inactivated viral particles retain the ability to induce an immune response.[30,31] Thirdly, neutralizing antibody is rare and reinfection can occur despite antibody production against ORF. This means that repeated doses can potentially be given to the same patient,[28] a logistical improvement over other OVs in clinical development that require serotype switching or second doses of antigenically unique viruses for continued response. Lastly, clinical response with the use of lower viral titers of ORFV is another practical improvement for OV development, as OV production is difficult, cost- and time-intensive and typically requires titers in the range of $10^6$ to $10^9$ PFU per injection.

In summary, HOV-189 is a novel wild-type chimeric parapoxvirus effective against TNBC both in vitro and in vivo. With targeted therapies lacking for TNBC treatment, HOV-189 represents a promising avenue for immunotherapeutics in this field. In terms of future directions, Applicants plan further preclinical testing in other xenograft models, as well as genetic modifications to the wild-type virus to enhance tumor selectivity and overall potency.

TABLE 4

Viral biodistribution of HOV-189 in various organs after 1 and 6 weeks post-treatment.

| | Viral Titer at 1 week (PFU/g tissue) | | | | Viral Titer at 6 weeks (PFU/g tissue) | | | |
|---|---|---|---|---|---|---|---|---|
| | Titer | Animals detected/total animals tested | SD | Limit of detection | Titer | Animals detected/total animals tested | SD | Limit of detection |
| Tumor | $1.64 \times 10^4$ | 3/3 | $1.22 \times 10^4$ | | $1.18 \times 10^3$ | 4/4 | $1.24 \times 10^3$ | |
| Brain | ND | 0/3 | | $2.52 \times 10^2$ | ND | 0/4 | | $2.53 \times 10^2$ |
| Heart | $1.07 \times 10^2$ | 1/3 | $1.85 \times 10^2$ | | ND | 0/4 | | $4.28 \times 10^2$ |
| Lung | $8.96 \times 10^2$ | 3/3 | $7.23 \times 10^2$ | | $3.33 \times 10^1$ | 1/4 | $6.67 \times 10^1$ | |
| Liver | ND | 0/3 | | $1.14 \times 10^2$ | ND | 0/4 | | $1.12 \times 10^2$ |
| Spleen | ND | 0/3 | | $4.87 \times 10^2$ | ND | 0/4 | | $6.58 \times 10^2$ |
| Kidney | ND | 0/3 | | $2.43 \times 10^2$ | ND | 0/4 | | $2.57 \times 10^2$ |
| Ovary | ND | 0/3 | | $2.62 \times 10^3$ | ND | 0/4 | | $4.39 \times 10^2$ |

Example 5. Construction of Recombinant Chimeric Poxviruses

Construction of shuttle vectors for insertion of foreign gene expression cassettes into the genome of the #33 chimeric poxvirus To construct thymidine kinase (TK) shuttle vector, the left and right flanking sequences of the TK gene of #33 chimeric poxvirus were PCR-amplified from #33 genomic DNA using Q5 High-Fidelity 2×Master Mix (New England Biolabs Inc., Ipswich, MA) and the primers: 5'-GCGCATATGATCTATGGATTACCATGGATGACAACTC-3' (SEQ ID NO:21) and 5'-CGTTTAACTCGTCTAATTAATTCTGTAC-3' (SEQ ID NO:22) (left flank), 5'-CAGGTAAAAGTACAGAATTAATTAGACGAGTTAAACGAGCTCGTCGACGGATCCGC TAGCGGCCGCGGAGGTAATGATATGTATCAATCGGTGTGTAG-3' (SEQ ID NO:23) and 5'-GCGGAATTCGTAATTACTTAGTAAATCCGCCGTACTAGG-3' (SEQ ID NO:24) (right flank). The two fragments were joined together using the method of gene splicing by overlapping extension.[32] The resulting fragment was digested with NdeI and EcoRI and cloned into the same-cut plasmid pGPT to yield p33NC-TK. The flanking sequences of TK in the shuttle vector were confirmed by sequencing. p33NC- TK contains the left and right flanking sequences of TK separated by SacI, SalI, BamHI, NheI and NotI, and *Escherichia coli* guanine phosphoribosyltransferase (gpt) gene driven by the vaccinia virus (VACV) early promoter p7.5E as a transient dominant selectable marker.

The F14.5L shuttle vector was constructed similarly. The left and right flanking sequences of the F14.5L gene of #33 chimeric poxvirus were PCR-amplified from #33 genomic DNA using Q5 High-Fidelity 2×Master Mix (New England Biolabs Inc., Ipswich, MA) and the primers: 5'-GCG-CATATGTAGAAGAATTGATAAATATGAAACCTTT-TAAG-3' (SEQ ID NO:25) and 5'-CCTCTCTAGCTTT-CACTTAAACTGTATCG-3' (SEQ ID NO:26) (left flank), 5'-GAATAATCGATACAGTTTAAGT-GAAAGCTAGAGAGGAAGCTTGAGCTCGA GGATCCGCTAGCGGCCGCTGAAGAG-GATGCTAGAATCAAGGAGGAGCAAG-3' (SEQ ID NO:27) and 5'-GCGGAAT-TCTCCGGGCAGTGACTTTGTAGCTCTCCCAG-3' (SEQ ID NO:28) (right flank). The two fragments were joined together using the method of gene splicing by overlapping extension. The resulting fragment was digested with NdeI and EcoRI and cloned into the same-cut plasmid pGPT to yield p33NC-F14.5L. The flanking sequences of F14.5L in the shuttle vector were confirmed by sequencing. p33NC-F14.5L contains the left and right flanking sequences of F14.5L separated by HindIII, SacI, XhoI, BamHI, NheI and NotI, and *Escherichia coli* gpt driven by the VACV early promoter p7.5E as a transient dominant selectable marker.

Construction of Shuttle Vectors for Fusion of microRNA Target Sequences with Essential Genes of the #33 Chimeric Poxvirus In order to fuse the target sequence of miR-100 to the 3' end of uracil DNA glycosylase (encoded by the gene D4R in vaccinia virus) of the #33 chimeric poxvirus, the left and right flanking sequences of the D4R gene of #33 chimeric poxvirus were PCR-amplified from #33 genomic DNA using Q5 High-Fidelity 2×Master Mix (New England Biolabs Inc., Ipswich, MA) and the primers: 5'-GCG-CATATGCACGCGCCATATACTATTACTTATCAC-GATG-3' (SEQ ID NO:29) and 5'-TTAATAAATAAACCCTTGAGCCCAATTTATAGG-3' (SEQ ID NO:30) (left flank), 5'-CCTATAAATTGGGCT-CAAGGGTTTATTTATTAACACAAGTT CGGATC-TACGGGTTcgatCACAAGTTCGGATCTACGGGT-TaccggtCACAAGTTCGGATCT ACGGGTTtcacCACAAGTTCGGATC-TACGGGTTTGCTTTAGTGAAATTTTAACTTGTGT TC-3' (SEQ ID NO:31) and 5'-GCGGAATTCCTAGTACC-TACAACCCGAAGAGTTG-3' (SEQ ID NO:32) (right flank). The two fragments were joined together using the method of gene splicing by overlapping extension. The resulting fragment was digested with NdeI and EcoRI and cloned into the same-cut plasmid pGPT to yield p33NCD4R-miR100t and p33NCD4R-miR100t-2. The flanking sequences of D4R in the shuttle vectors were confirmed by sequencing. p33NCD4R-miR100t contains 4 copies of the miR-100 target sequence fused to the 3'-end of D4R as expected whereas p33NCD4R-miR100t-2 is a spontaneous mutant with 2 copies of the miR-100 target sequence deleted. Both vectors contain *Escherichia* coli gpt driven by the VACV early promoter p7.5E as a transient dominant selectable marker.

To fuse the target sequence of Let-7c to the 3' end of uracil DNA glycosylase (encoded by the gene D4R in vaccinia virus) of the #33 chimeric poxvirus, the left and right flanking sequences of the D4R gene of #33 chimeric poxvirus were PCR-amplified from #33 genomic DNA using Q5 High-Fidelity 2×Master Mix (New England Biolabs Inc., Ipswich, MA) and the primers: 5'-GCG-CATATGCACGCGCCATATACTATTACTTATCAC-GATG-3' (SEQ ID NO:33) and 5'-TTAATAAATAAACCCTTGAGCCCAATTTATAGG-3' (SEQ ID NO:34) (left flank), 5'-CCTATAAATTGGGCT-CAAGGGTTTATTTATTAAAACCATACAACCT ACT-ACCTCAcgatAACCATACAACCTACTACCT-CAaccggtAACCATACAACCTACTACCT CAtcacAACCATACAACCTACTACCTCATGCTTTAGT-GAAATTTTAACTTGTGTTC-3' (SEQ ID NO:35) and 5'-GCGGAATTCCTAGTACCTA-CAACCCGAAGAGTTG-3' (SEQ ID NO:36) (right flank). The two fragments were joined together using the method of gene splicing by overlapping extension. The resulting fragment was digested with NdeI and EcoRI and cloned into the same-cut plasmid pGPT to yield p33NCD4R-Let7ct. The flanking sequences of D4R in the shuttle vector were confirmed by sequencing. p33NCD4R-Let7ct contains 4 copies of the Let-7c target sequence fused to the 3'-end of D4R as expected. It contains *Escherichia coli* gpt driven by the VACV early promoter p7.5E as a transient dominant selectable marker.

In order to fuse the target sequence of miR-100 to the 3' end of DNA polymerase (encoded by the gene E9L in vaccinia virus) of the #33 chimeric poxvirus, the left and right flanking sequences of the E9L gene of #33 chimeric poxvirus were PCR-amplified from #33 genomic DNA using Q5 High-Fidelity 2×Master Mix (New England Biolabs Inc., Ipswich, MA) and the primers: 5'-GCGGGCGCCGAGTTTGAGGCGGTATATAAGAAT CTGATTATGC-3' (SEQ ID NO:37) and 5'-TTATGCTTCGTAAAATGTAGGTTTTGAACC-3' (SEQ ID NO:38) (left flank), 5'-GGTTCAAAACCTACAT-TTTACGAAGCATAA CACAAGTTCGGATC-TACGGGTTcgatCACAAGTTCGGATCTACGGGT-TaccggtCACAAGT TCGGATCTACGGGTTtcacCACAAGTTCGGATC-TACGGGTTAATAATTTACAACAGTTG TACGTCGCTCTTTG-3' (SEQ ID NO:39) and 5'-GCGCAATTGCATTGCTAATGGAT CGTTCTCTGGTAGATACG-3' (SEQ ID NO:40) (right flank). The two fragments were joined together using the method of gene splicing by overlapping extension. The resulting fragment was digested with NarI and MfeI and cloned into the plasmid pGPT cut with NarI and EcoRI to yield p33NCE9L-miR100t. The flanking sequences of ELL in the shuttle vector were confirmed by sequencing. p33NCE9L-miR100t contains 4 copies of the miR-100 target sequence fused to the 3'-end of E9L as expected. It also contains *Escherichia coli* gpt driven by the VACV early promoter p7.5E as a transient dominant selectable marker.

To fuse the target sequence of Let-7c to the 3' end of DNA polymerase (encoded by the gene E9L in vaccinia virus) of the #33 chimeric poxvirus, the left and right flanking sequences of the E9L gene of #33 chimeric poxvirus were PCR-amplified from #33 genomic DNA using Q5 High-Fidelity 2×Master Mix (New England Biolabs Inc., Ipswich, MA) and the primers: 5'-GCGGGCGCCGAGTTT-GAGGCGGTATATAAGAATCTGATTATGC-3' (SEQ ID NO:41) and 5'-TTATGCTTCGTAAAATGTAGGTTTT-GAACC-3' (SEQ ID NO:42) (left flank), 5'-GGTT-CAAAACCTACATTTTACGAAGCATAAAACCATA-CAACCTACTACCTCAcgatAA CCATACAACCTACTACCTCAaccggtAACCATA-CAACCTACTACCTCAtcacAACCATACA ACCTAC- TACCTCAAATAATTTA-CAACAGTTGTACGTCGCTCTTTG-3' (SEQ ID NO:43) and 5'-GCGCAATTGCATTGCTAATG-GATCGTTCTCTGGTAGATACG-3' (SEQ ID NO:44) (right flank). The two fragments were joined together using the method of gene splicing by overlapping extension. The resulting fragment was digested with NarI and MfeI and cloned into the plasmid pGPT cut with NarI and EcoRI to yield p33NCE9L-Let7ct. The flanking sequences of E9L in the shuttle vector were confirmed by sequencing. p33NCE9L-Let7ct contains 4 copies of the Let-7c target sequence fused to the 3'-end of E9L as expected. It also contains *Escherichia coli* gpt driven by the VACV early promoter p7.5E as a transient dominant selectable marker.

Insertion of Foreign Gene Expression Cassettes into the TK and F14.5L Shuttle Vectors Human sodium and iodide symporter (hNIS) expression cassette. The hNIS expression cassette with the VACV synthetic early promoter (SE) was PCR-amplified using Q5 High-Fidelity 2×Master Mix (New England Biolabs Inc., Ipswich, MA) and the primers: 5'-GCGAAGCTTGAGCT-CAAAAATT-GAAAAACTAGCGTCTTTTTTTGCTCGAAGTCGACC ACCATGGAGGCCGTGGAG-3' (SEQ ID NO:45) and 5'-GCGGATCCATAAAAATTAATT AATCAGAGGTTTGTCTCCTGCTGGTCTCG-3' (SEQ ID NO:46). The PCR fragment was digested with SacI and BamHI and cloned into the same-cut plasmid p33NC-TK to yield p33NCTK-SE-hNIS. The sequence of the hNIS expression cassette was confirmed by sequencing.

Emerald (a variant of GFP) expression cassette. The Emerald expression cassette with the VACV H5 early/late promoter was PCR-amplified from the plasmid Emerald-pBAD (Addgene, Cambridge, MA) using Q5 High-Fidelity 2×Master Mix (New England Biolabs Inc., Ipswich, MA) and the primers: 5'-GCGAAGCTTGAGCTCAAAAATT-GAAAATAAATACAAAGGTTCTTGAGGGTTGTGTT AAATTGAAAGCGAGAAATAATCATAAATAGTCGAC-CACCATGGTGAGCAAGGGCGA GGAGCTGTTCACC-3' (SEQ ID NO:47) and 5'-GCGGGATCCATAAAAAT-TAATTA ATCAGTACAGCTCGTCCATGCCGAGAGTGATC-3' (SEQ ID NO:48). The PCR fragment was digested with SacI and BamHI and cloned into the same-cut plasmid p33NC-TK to yield p33NCTK-115-Emerald. The sequence of the Emerald expression cassette was confirmed by sequencing.

Firefly luciferase expression cassettes. The firefly luciferase expression cassette with the VACV 11K late promoter was PCR-amplified from the plasmid pCDNA3.1(+)/Luc2=tdT (Addgene, Cambridge, MA) using Q5 High-Fidelity 2×Master Mix (New England Biolabs Inc., Ipswich, MA) and the primers: 5'-GCGAAGCTT-GAGCTCTAGTAGAATTTCATTTTGTTTTTTTC-TATGCTATAAATAGTCG ACCACCATGGAAGATGC-CAAAAACATTAAGAAGGGCCCAGC-3' (SEQ ID NO:49) and 5'-GCGGGATCCATAAAAATTAATTAAT-CACACGGCGATCTTGCCGCCCTTCT TGGCCTTAAT-GAG-3' (SEQ ID NO:50). The PCR fragment was digested with SacI and BamHI and cloned into the same-cut plasmid p33NC-TK to yield p33NCTK-11K-Fluc2. The sequence of the firefly luciferase expression cassette was confirmed by sequencing. To generate plasmids containing the firefly luciferase expression cassettes with the VACV SE and H5 promoters, the firefly luciferase cDNA was PCR-amplified from the plasmid pCDNA3.1(+)/Luc2=tdT (Addgene, Cambridge, MA) using Q5 High-Fidelity 2×Master Mix (New England Biolabs Inc., Ipswich, MA) and the primers: 5'-GCGGTCGACCACCATGGAAGATGCCAAAAACAT-TAAGAAGGGCCCAGC-3' (SEQ ID NO:51) and 5'-GCGGGATCCATAAAAATTAATTAATCACACGGC-GATCTTGCC GCCCTTCTTGGCCTTAATGAG-3' (SEQ ID NO:52). The PCR fragment was digested with SalI and BamHI and cloned into the same-cut plasmids p33NCTK-SE-hNIS and p33NCTK-H5-Emerald replacing hNIS and Emerald to yield p33NCTK-SE-Fluc2 and p33NCTK-115-Fluc2, respectively. The sequence of the firefly luciferase cDNA in both vectors was confirmed by sequencing.

mCherry expression cassettes. The mCherry cDNA was PCR-amplified from the plasmid pLV-mCherry (Addgene, Cambridge, MA) using Q5 High-Fidelity 2×Master Mix (New England Biolabs Inc., Ipswich, MA) and the primers: 5'-GCGGTCGACCACCATGGTGAGCAAGGGCGAG-GAGGATAACATGG-3' (SEQ ID NO:53) and 5'-GCGG-GATCCATAAAAATTAATTAATCACTTGTA-CAGCTCGTCCATGCCG CCGGTGGAGTGG-3' (SEQ ID NO:54). The PCR fragment was digested with SalI and BamHI and cloned into the same-cut plasmids p33NCTK-H5-Emerald and p33NCTK-11K-Fluc2 replacing Emerald and firefly luciferase to yield p33NCTK-115-mCherry and p33NCTK-11K-mCherry, respectively. The sequence of the mCherry cDNA in both vectors was confirmed by sequencing.

Anti-PD-L1 single chain antibody expression cassette. The anti-PD-L1 single chain antibody expression cassette comprising the VACV H5 promoter, a Igκ light chain leader sequence, the $V_H$ and VL chain sequences of atezolizumab separated by a (G4S)3 linker sequence, and a C-terminal FLAG tag sequence was synthesized by Integrated DNA Technologies (Coralville, Iowa). The fragment was digested with HindIII and BamHI and cloned into the same-cut plasmids p33NC-F14.5L to yield p33NCF14.5L-H5-anti-PD-L1. The sequence of the anti-PD-L1 single chain antibody expression cassette was confirmed by sequencing.

Generation of Recombinant Chimeric Poxviruses

CV-1 cells were infected with parental viruses at a multiplicity of infection (MOI) of 0.1 for 1 h, then transfected with transfer vectors (Table 5) by use of JETPRIME™ in vitro DNA & siRNA transfection reagent (Polyplus-transfection Inc. New York, NY). Two days post infection, infected/transfected cells were harvested and the recombinant viruses were selected and plaque purified as described previously.[33]

TABLE 5

List of recombinant chimeric poxviruses.

| Recombinant Chimeric Poxviruses | Parent Virus | Transfer Vector | Genotype |
|---|---|---|---|
| 33-D4RmiR100t-2 | #33 | p33NCD4R-miR100t-2 | The target sequence (2 copies) of miR-100 fused to the 3'-end of D4R |

TABLE 5-continued

| List of recombinant chimeric poxviruses. | | | |
|---|---|---|---|
| Recombinant Chimeric Poxviruses | Parent Virus | Transfer Vector | Genotype |
| 33-D4RmiR100t | #33 | p33NCD4R-miR100t | The target sequence (4 copies) of miR-100 fused to the 3'-end of D4R |
| 33-D4Rlet7ct | #33 | p33NCD4R-let7ct | The target sequence (4 copies) of Let-7c fused to the 3'-end of D4R |
| 33-E9LmiR100t | #33 | p33NCE9L-miR100t | The target sequence (4 copies) of miR-100 fused to the 3'-end of E9L |
| 33-E9Llet7ct | #33 | p33NCE9L-let7ct | The target sequence (4 copies) of Let-7c fused to the 3'-end of E9L |
| 33ΔTK | #33 | p33NC-TK | TK-inactivated |
| 33-(SE)hNIS | #33 | p33NCTK-SE-hNIS | (SE)hNIS inserted at TK |
| 33-(H5)Emerald | #33 | p33NCTK-H5-Emerald | (H5)Emerald inserted at TK |
| 33-(SE)Fluc2 | #33 | p33NCTK-SE-Fluc2 | (SE)Fluc2 inserted at TK |
| 33-(H5)Fluc2 | #33 | p33NCTK-H5-Fluc2 | (H5)Fluc2 inserted at TK |
| 33-(11K)Fluc2 | #33 | p33NCTK-11K-Fluc2 | (11K)Fluc2 inserted at TK |
| 33-(H5)mCherry | #33 | p33NCTK-H5-mCherry | (H5)mCherry inserted at TK |
| 33-(11K)mCherry | #33 | p33NCTK-11K-mCherry | (11K)mCherry inserted at TK |
| 33-(SE)hNIS-D4RmiR100t-2 | 33-(SE)hNIS | p33NCD4R-miR100t-2 | (SE)hNIS inserted at TK; The target sequence (2 copies) of miR-100 fused to the 3'-end of D4R |
| 33-(SE)hNIS-D4R-miR100t | 33-(SE)hNIS | p33NCD4R-miR100t | (SE)hNIS inserted at TK; The target sequence (4 copies) of miR-100 fused to the 3'-end of D4R |
| 33-(SE)hNIS-D4Rlet7ct | 33-(SE)hNIS | p33NCD4R-let7ct | (SE)hNIS inserted at TK; The target sequence (4 copies) of Let-7c fused to the 3'-end of D4R |
| 33-(SE)hNIS-E9LmiR100t | 33-(SE)hNIS | p33NCE9L-miR100t | (SE)hNIS inserted at TK; The target sequence (4 copies) of miR-100 fused to the 3'-end of E9L |
| 33-(SE)hNIS-E9Llet7ct | 33-(SE)hNIS | p33NCE9L-let7ct | (SE)hNIS inserted at TK; The target sequence (4 copies) of Let-7c fused to the 3'-end of E9L |
| 33ΔF14.5L | #33 | p33NC-F14.5L | F14.5L-inactived |
| 33-(H5)anti-PD-L1 | #33 | p33NCF14.5L-H5-anti-PD-L1 | (H5)anti-PD-L1 inserted at F14.5L |
| 33-(SE)hNISΔF14.5L | 33-(SE)hNIS | p33NC-F14.5L | SE)hNIS inserted at TK; F14.5L-inactived |
| 33-(SE)hNIS-(H5)anti-PD-L1 | 33-(SE)hNIS | p33NCF14.5L-H5-anti-PD-L1 | SE)hNIS inserted at TK; (H5)anti-PD-L1 inserted at F14.5L |

Example 6. Chimeric Poxvirus Compositions and Uses Thereof

Applicants recently developed novel oncolytic chimeric poxviruses using their unique methodology for the generation of viral chimeras, followed by high-throughput screening in the NCI-60 cell lines and pancreatic cell lines. These novel chimeric poxviruses harness the best targeting potential of multiple parental viruses, showing superior tumoricidal activity in over 70 cancer cell lines compared to their parent viruses and oncolytic viruses currently in human clinical trials. In human triple-negative breast cancer, pancreatic cancer and lung cancer xenograft models, the novel chimeric poxviruses could shrink tumors with a single intratumoral injection of as low as 1000 plaque-forming units of virus without overt side effects. This is 2-5 logs lower than most oncolytic viruses under clinical testing. In addition, chimeric poxviruses efficiently spread from injected tumors to non-injected tumors, resulting in great abscopal effects (shrinkage of non-injected distant tumors).

To help monitor virus infection and replication in vitro and in vivo, Emerald (a variant of GFP), mCherry (red fluorescent protein), and firefly luciferase expression cassettes were inserted into chimeric poxviruses. Expression of these optical imaging genes is easily detectable, thus greatly aiding monitoring virus replication and spread in vivo without significantly affecting virus replication and efficacy.

Arming oncolytic viruses with therapeutic genes is a widely accepted strategy to improve the antitumor efficacy of oncolytic viruses. Among all tested therapeutic genes, human sodium and iodine symporter (hNIS) has shown great promise both in preclinical and clinical studies. hNIS is a membrane-bound glycoprotein present on the basolateral surface of thyroid follicular cells. It facilitates the transport of iodine into the cytoplasm, where it is organificated in the process of thyroid hormone synthesis. This molecule has been successfully used to accumulate radioiodine in both imaging and treatment of differentiated thyroid cancer, yielding a high response and cure rate (>90%). The hNIS expression cassette has been inserted into chimeric poxviruses in order to convert non-thyroid cancers into "thyroid-like" cancer, which is expected to respond to radioiodine or rhenium-188 therapy. Thus, non-thyroid cancers after conversion to "thyroid-like" cancer will become imageable using radioiodine, and will be potentially destroyed by at least three mechanisms: intrinsic oncolytic activity of oncolytic viruses, targeted radiotherapy, and anti-tumor immune responses mediated by oncolytic viruses and radiotherapy. Applicants have shown that hNIS is properly expressed on the cell membrane of tumor cells after infection with hNIS-expressing chimeric poxvirus. Furthermore, initial experimental results indicate that insertion of the hNIS expression cassette does not affect the intrinsic oncolytic activity of the parent viruses both in vitro and in animal models. In addition, Applicants have shown that hNIS-expressing chimeric poxviruses are safe in mice bearing tumors.

Immune checkpoint inhibitors represent breakthrough drugs in the treatment of solid tumors, and have been approved for the treatment of melanoma, non-small cell lung carcinoma and renal cell carcinoma. These drugs require a pre-existing anti-tumor immune response. Priming of the immune system by oncolytic viruses would sensitize the patient's immune repertoire to become more conducive to anti-PD-1/PD-L1 and anti-CTLA-4 therapies. Combining oncolytic viruses with immune checkpoint inhibitors can overcome multiple immune pathways inducing immune tolerance. In addition, oncolytic viruses promote infiltration of cytotoxic CD8 T cells into infected tumors and induce the up-regulation of CTLA-4 or PD-L1 through activation of IFN-γ producing cytotoxic CD8 T cells, thereby allowing anti-CTLA-4 and anti-PD-1/PD-L1 therapies to reach their maximum therapeutic potential. Data from several preclinical studies support combining oncolytic virotherapy with checkpoint blockade. Clinical trials evaluating the combination of the first FDA-approved oncolytic virus T-VEC with anti-CTLA-4 and anti-PD-1 antibodies are ongoing. The initial results are encouraging. To potentiate anti-tumor immune responses initiated by chimeric poxviruses, especially, chimeric poxviruses expressing hNIS, anti-PD-L1 expression cassette will be inserted into chimeric poxviruses or chimeric poxviruses expressing hNIS. Applicants expect that while insertion of hNIS into oncolytic viruses will enable synergistic tumor cell-killing with radioiodine and nuclear medicine imaging of infected tumor cells, expression of immunostimulatory transgenes such as anti-PD-L1 within the same vectors will greatly augment anti-tumor immune responses while potentially decreasing off target auto-immune toxicities.

Example 7. Targeting Pancreatic Cancer with Oncolytic Virotherapy

Cytotoxicity Assay

Figure 12A:
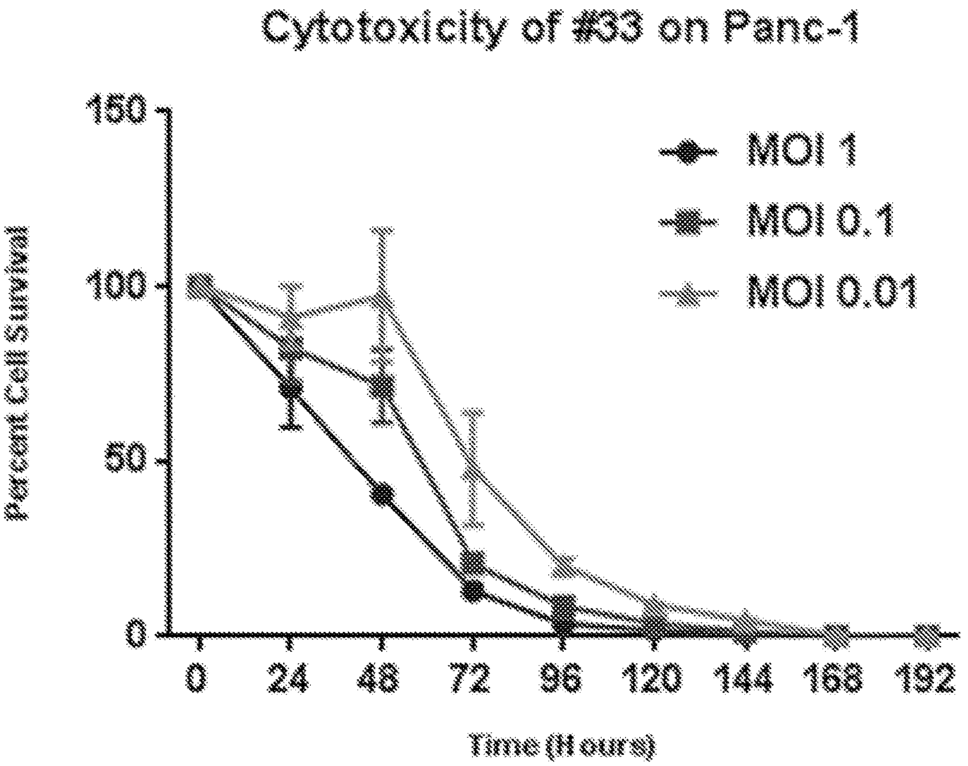
FIGS. 12A-12L. A cytotoxicity assay was performed on PANC-1, MiaPaCa-2, BxPC-3, SU.86.86, Capan-1, and AsPC-1 cancer cell lines by plating $3\times10^3$ cancer cells per well in 100 μL RPMI, 5% FBS, 1% Antibiotic-Antimycotic solution for 24 hours. 20 μL of the virus as indicated was then added at a multiplicity of infection (MOI) of 1, 0.1, and 0.01. A daily cell viability assay was performed by adding 20 μL of CELLTITER 96™ Aqueous One Solution Cell Proliferation Assay to all wells and taking a colorimetric reading after 1 hour of incubation. Experimental results were standardized to a media only and MOI 0 control. This experiment was repeated in triplicate. Presented are graphs showing percent cell survival over time for PANC-1 (FIG. 12A), MiaPaCa-2 (FIG. 12C), BxPC-3 (FIG. 12E), SU.86.86 (FIG. 12G), Capan-1 (FIG. 12I), and AsPC-1 (FIG. 12K) treated with #33 at a MOI of 1, 0.1, or 0.01. Also presented are bar graphs comparing percent cell survival at 120 hours for PANC-1 (FIG. 12B), MiaPaCa-2 (FIG. 12D), BxPC-3 (FIG. 12F), SU.86.86 (FIG. 12H), Capan-1 (FIG. 12J), and AsPC-1 (FIG. 12L) cancer cells treated with virus as indicated. Statistical analysis was performed comparing #33 to other experimental groups as indicated using One-Way ANOVA at each time point. For SU.86.86 (FIG. 12H), statistical analysis was performed using an unpaired t-test at each MOI.
Figure 12B:
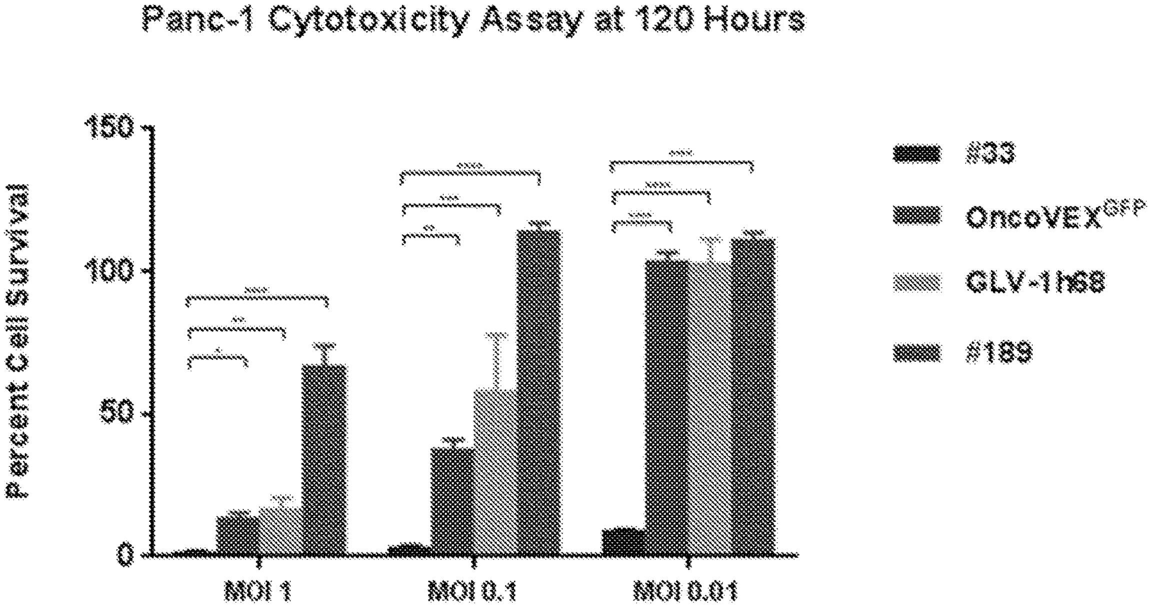
Figure 12C:
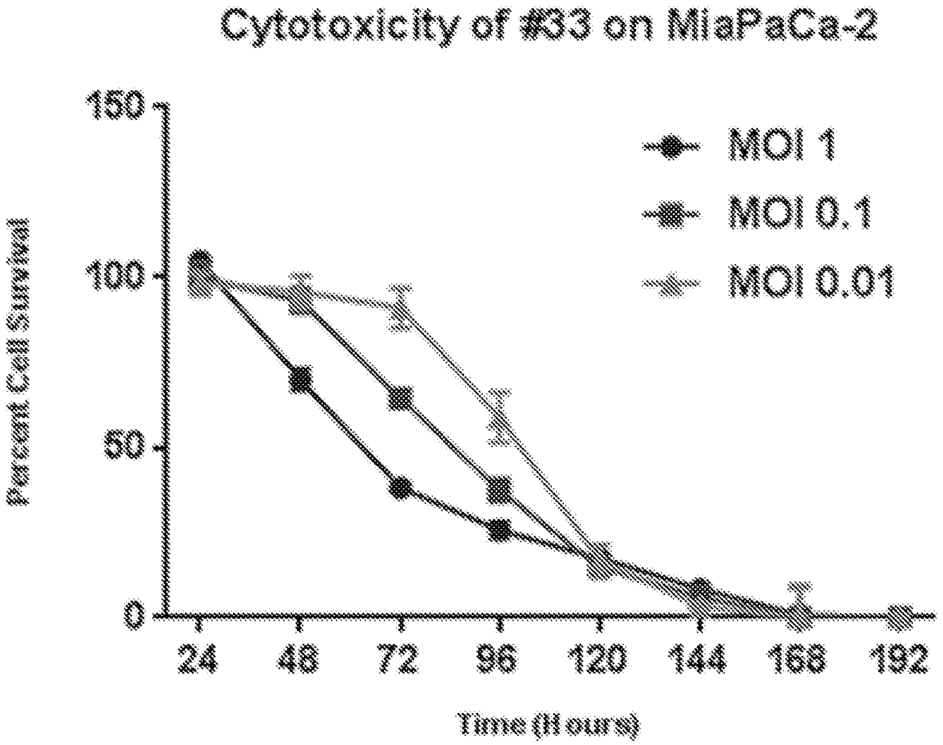
Figure 12D:
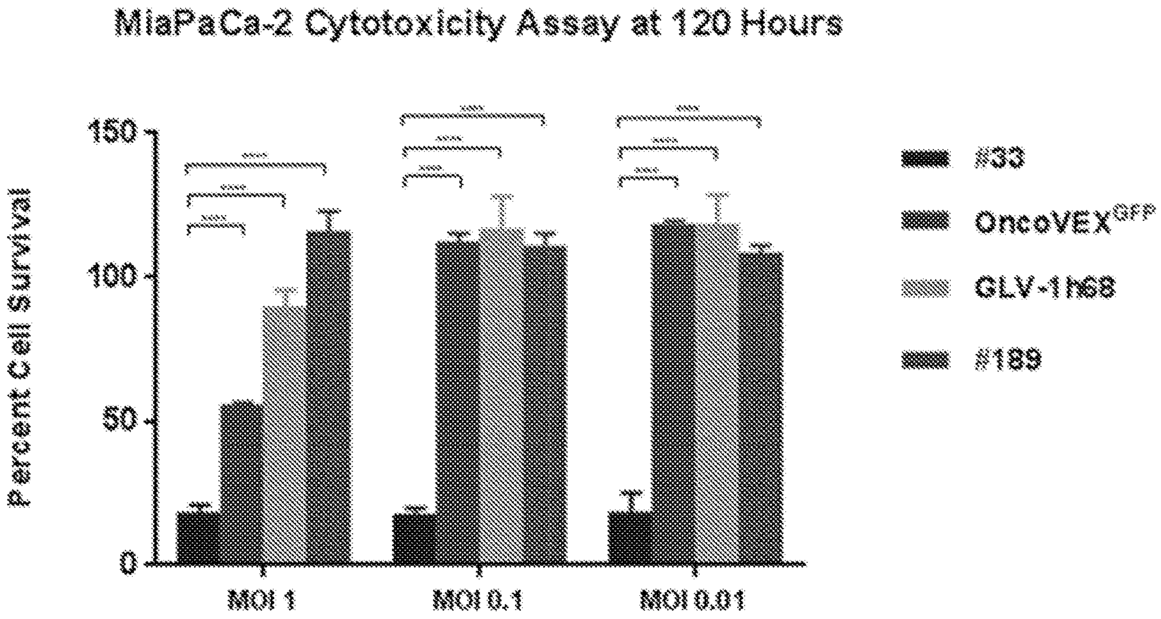
Figure 12E:
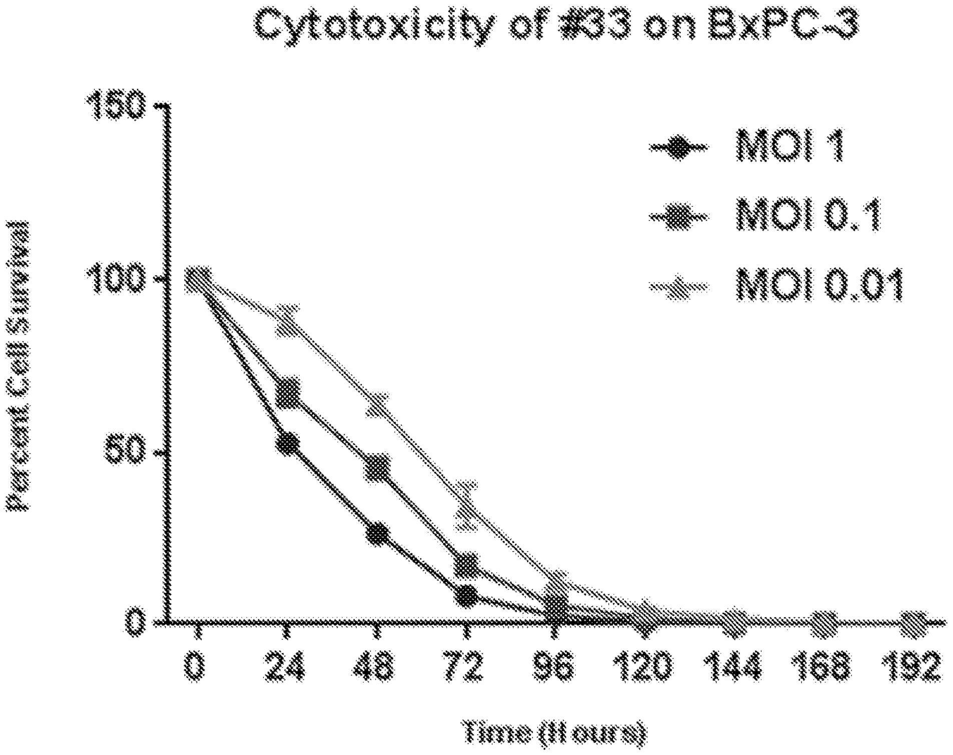
Figure 12F:
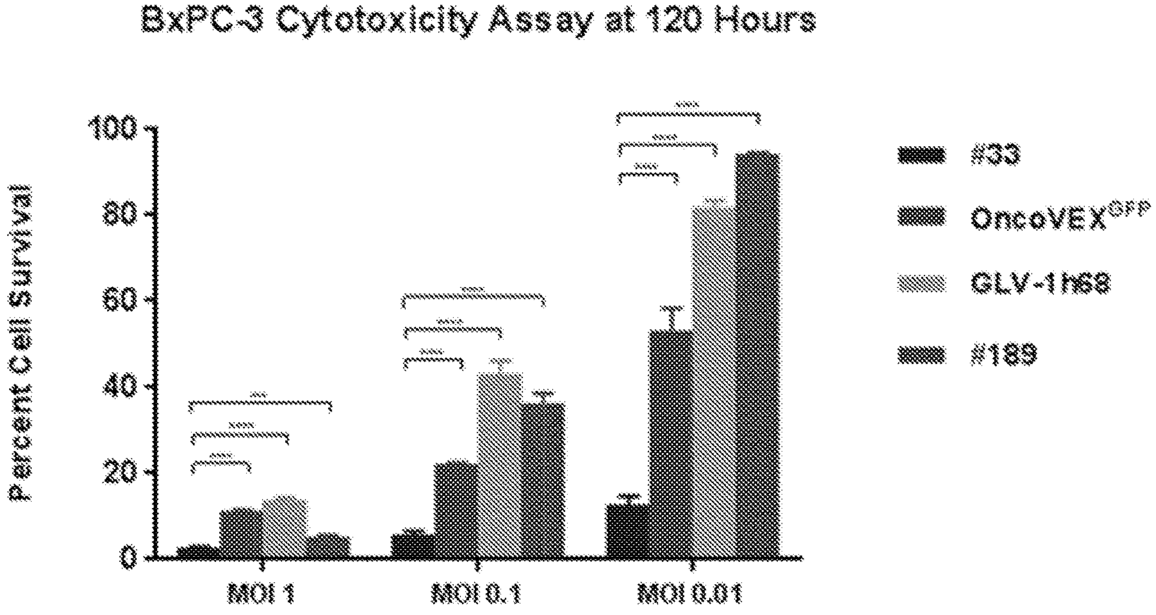
Figure 12G:
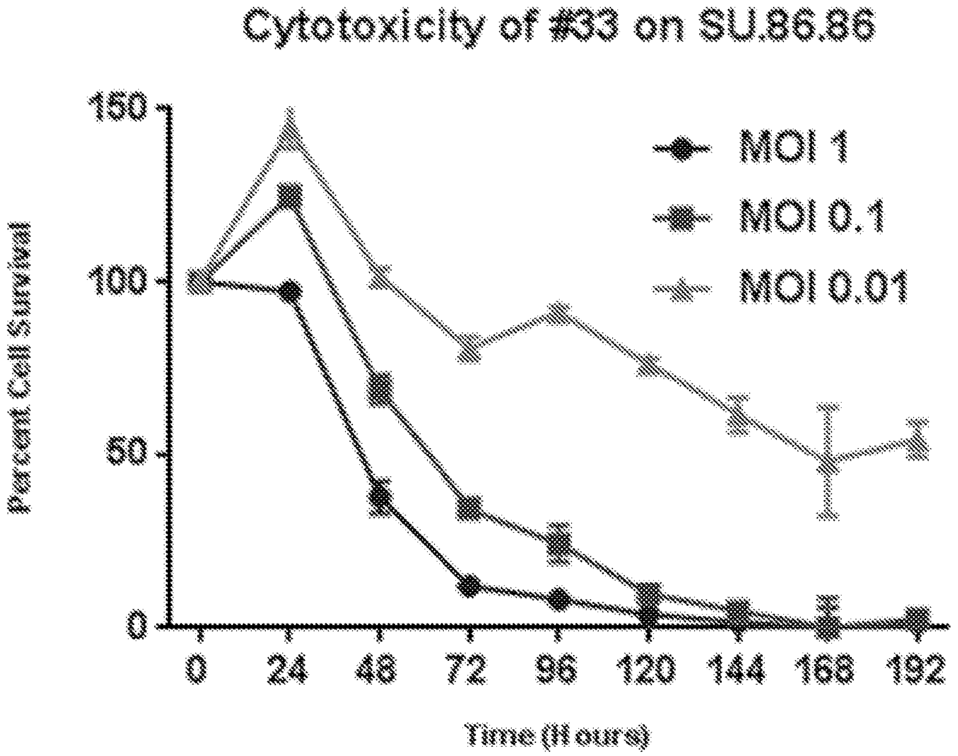
Figure 12H:
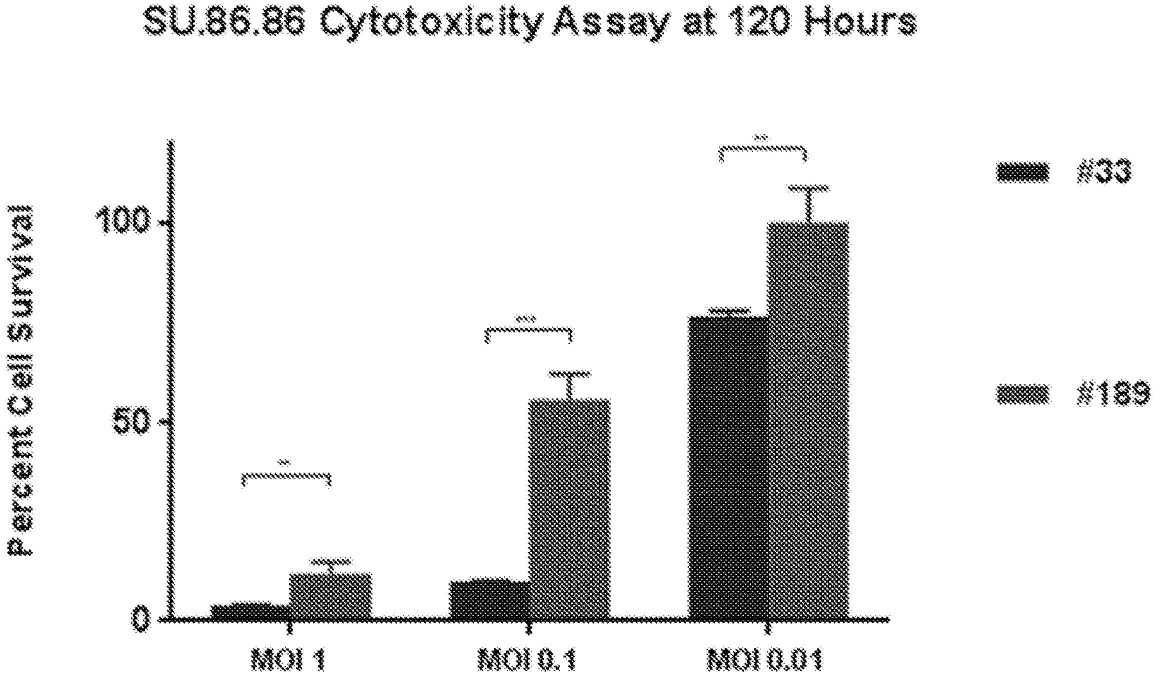
Figure 12I:
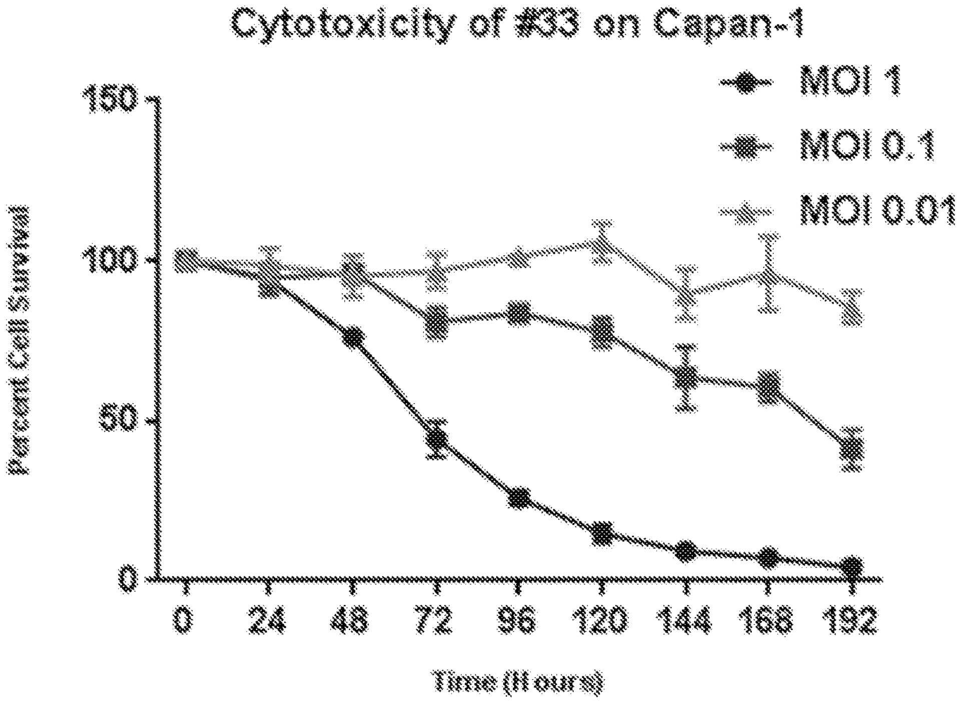
Figure 12J:
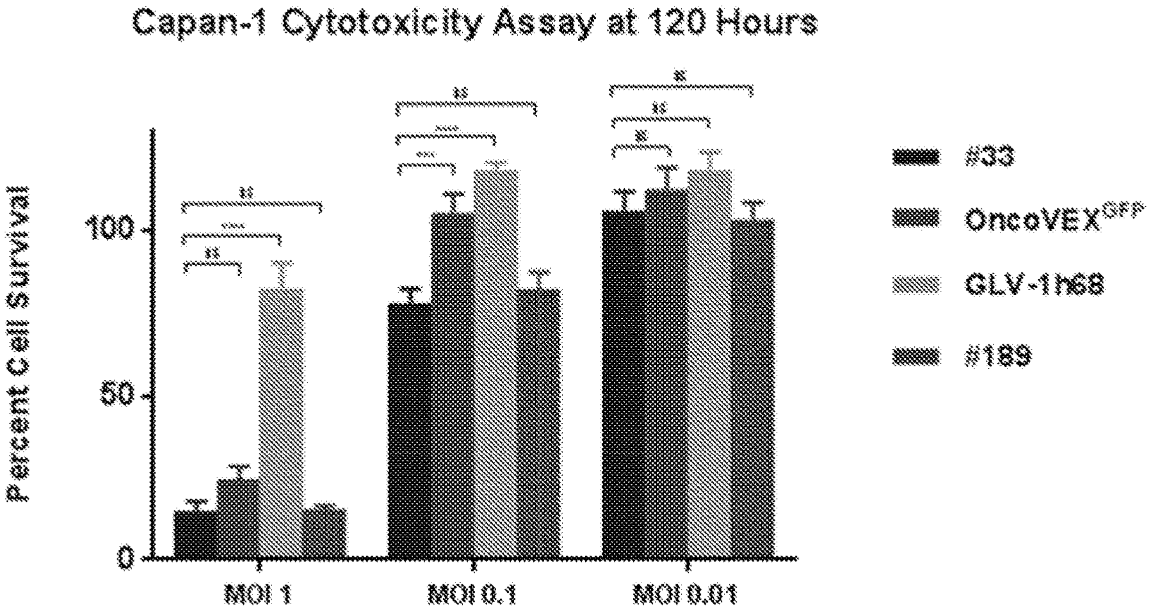
Figure 12K:
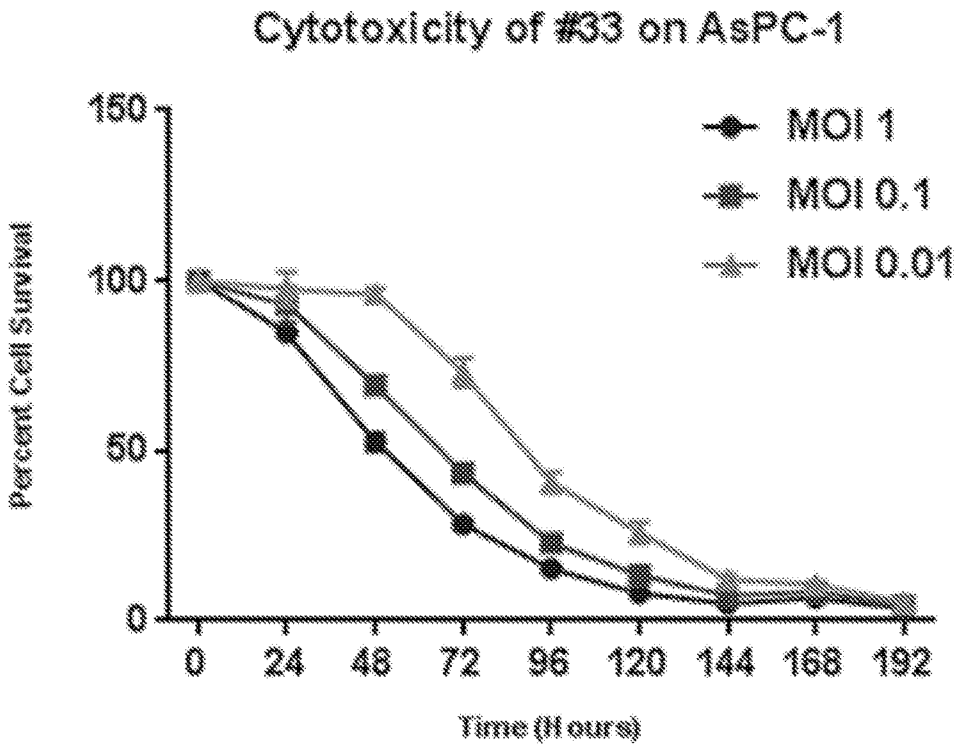
Figure 12L:
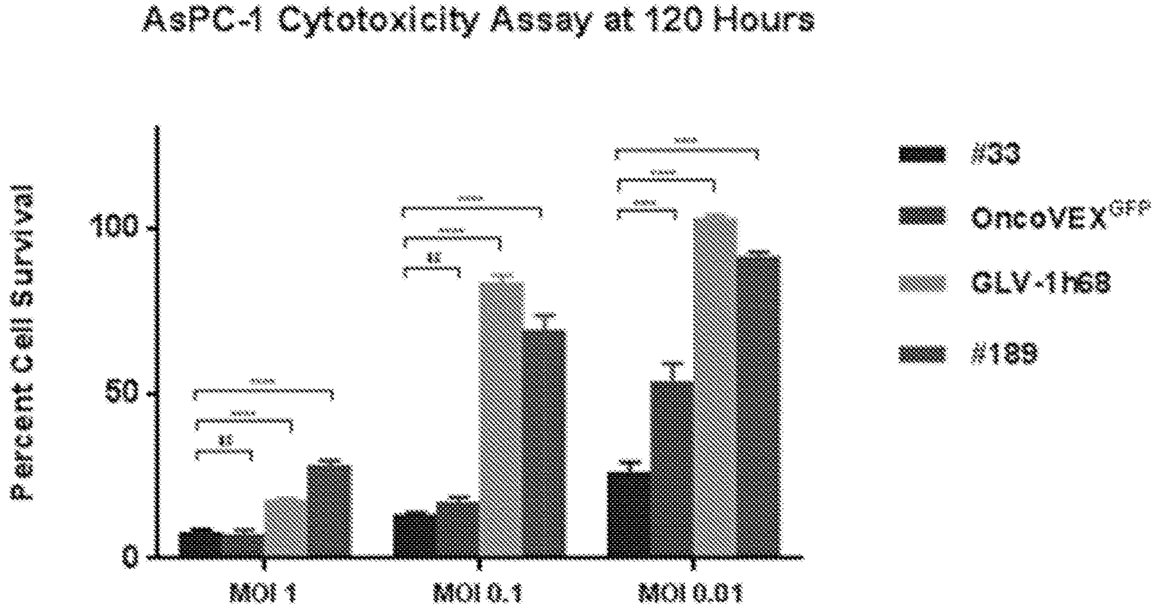

A cytotoxicity assay was performed on cancer cell lines Panc-1 (FIGS. 12A-12B), MiaPaCa-2 (FIGS. 12C-12D), BxPC-3 (FIGS. 12E-12F), SU.86.86 (FIGS. 12G-12H), Capan-1 (FIGS. 121-124 and AsPC-1 (FIGS. 12K-12K) by plating $3\times10^3$ cancer cells per well in 100 μL RPMI 5% FBS, 1% Antibiotic-Antimycotic solution for 24 hours. 20 μL of the virus, either #33, OncoVEX$^{GFP}$, GLV-1h68, or #189, was then added at a multiplicity of infection (MOI) of 1, 0.1, and 0.01. A daily cell viability assay was performed by adding 20 μL of CELLTITER 96™ Aqueous One Solution Cell Proliferation Assay to all wells and taking a colorimetric reading after 1 hour of incubation. Experimental results were standardized to a media only and MOI 0 control. This experiment was repeated in triplicate. Statistical analysis was performed comparing #33 to other experimental groups using One-Way ANOVA at each time point. For SU.86.86, statistical analysis was performed using an unpaired t-test at each MOI.

Viral Growth Curve

Figure 13A:
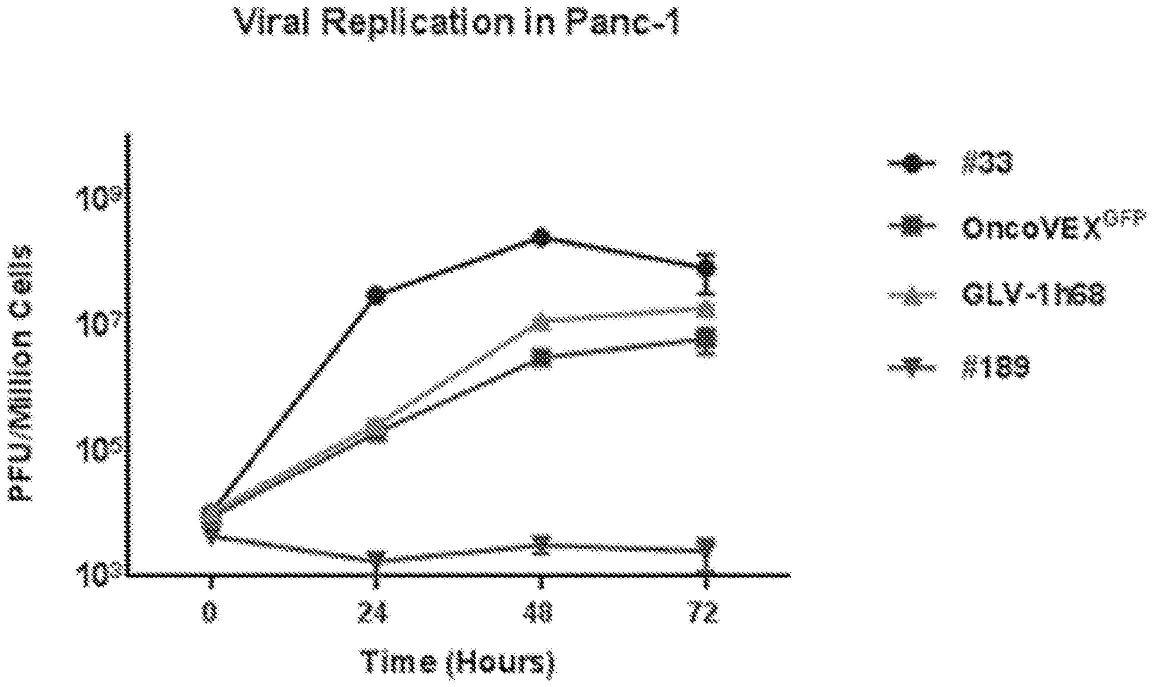
FIGS. 13A-13L. A viral replication curve was performed on PANC-1, MiaPaCa-2, BxPC-3, SU.86.86, Capan-1, and AsPC-1 cancer cell lines by plating cells at $5\times10^5$ cells per well in 2 mL RPMI, 10% FBS, 1% Antibiotic-Antimycotic solution for 24 hours in triplicate. Media was then aspirated and #33, OncoVEX GFP, GLV-1h68, or #189 was added at a multiplicity of infection (MOI) 0.01 in 500 μL RPMI, 2.5% FBS, 1% Antibiotic-Antimycotic solution for 1 hour shaking every 20 minutes. At one hour, the media was aspirated and 1.5 mL of RPMI, 2.5% FBS, 1% Antibiotic-Antimycotic solution was added. At 24, 48, and 72 hours, cells and supernatant were collected and after three freeze and thaw cycles serial dilutions were performed in duplicate. This experiment was repeated in duplicate. Presented are graphs showing PFU/Million cells over time for PANC-1 (FIG. 13A), MiaPaCa-2 (FIG. 13C), BxPC-3 (FIG. 13E), SU.86.86 (FIG. 13G), Capan-1 (FIG. 13I), and AsPC-1 (FIG. 13K) cancer cells treated with virus as indicated. Also presented are bar graphs comparing PFU/Million cells at each time point for each virus in PANC-1 (FIG. 13B), MiaPaCa-2 (FIG. 13D), BxPC-3 (FIG. 13F), SU.86.86 (FIG. 13H), Capan-1 (FIG. 13J), and AsPC-1 (FIG. 13L) treated cancer cells. Statistical analysis was performed comparing #33 to other experimental groups using One-Way ANOVA at each time point.
Figure 13B:
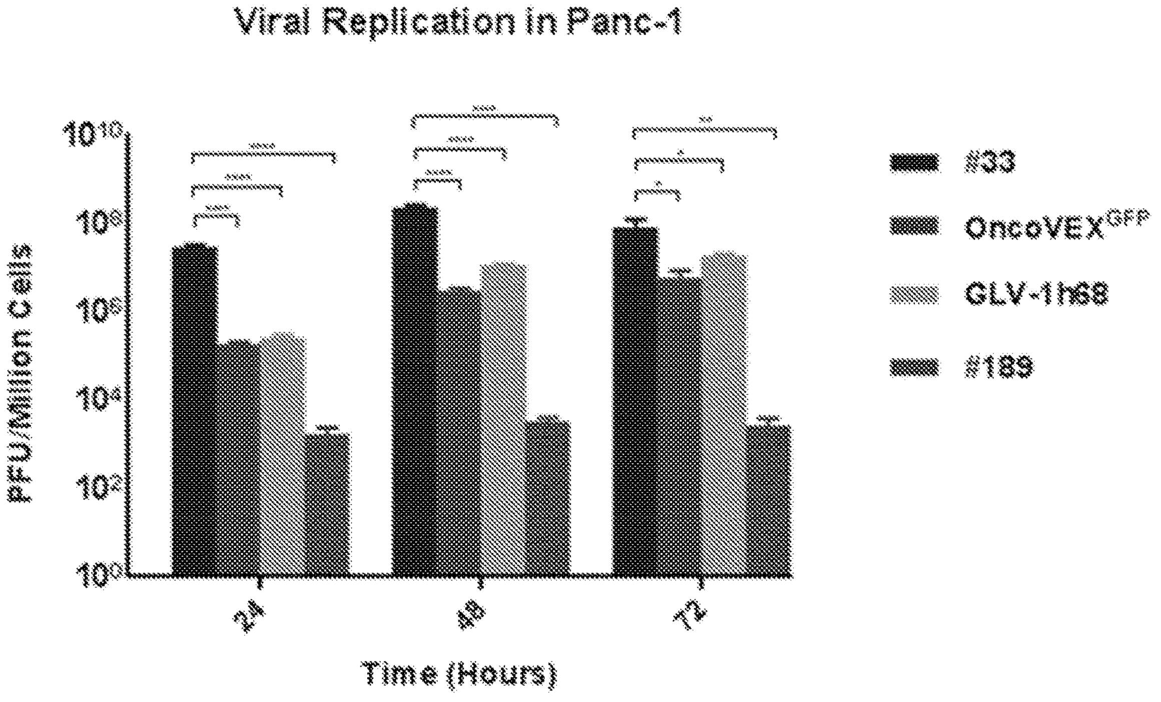
Figure 13C:
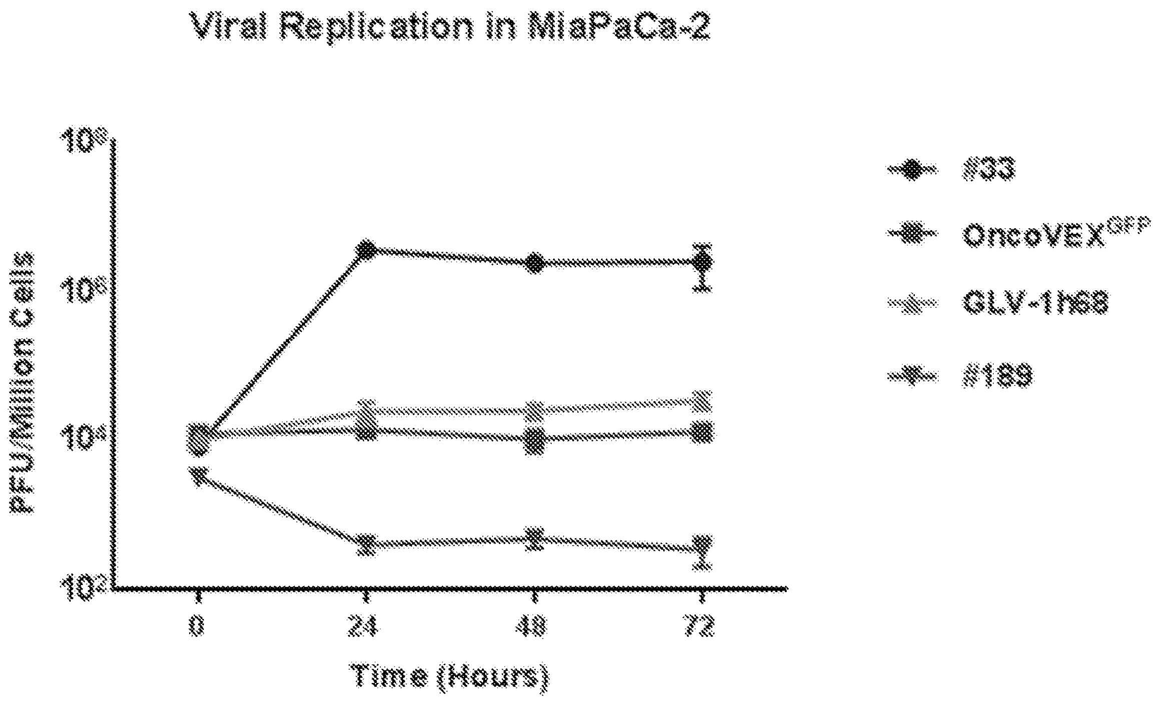
Figure 13D:
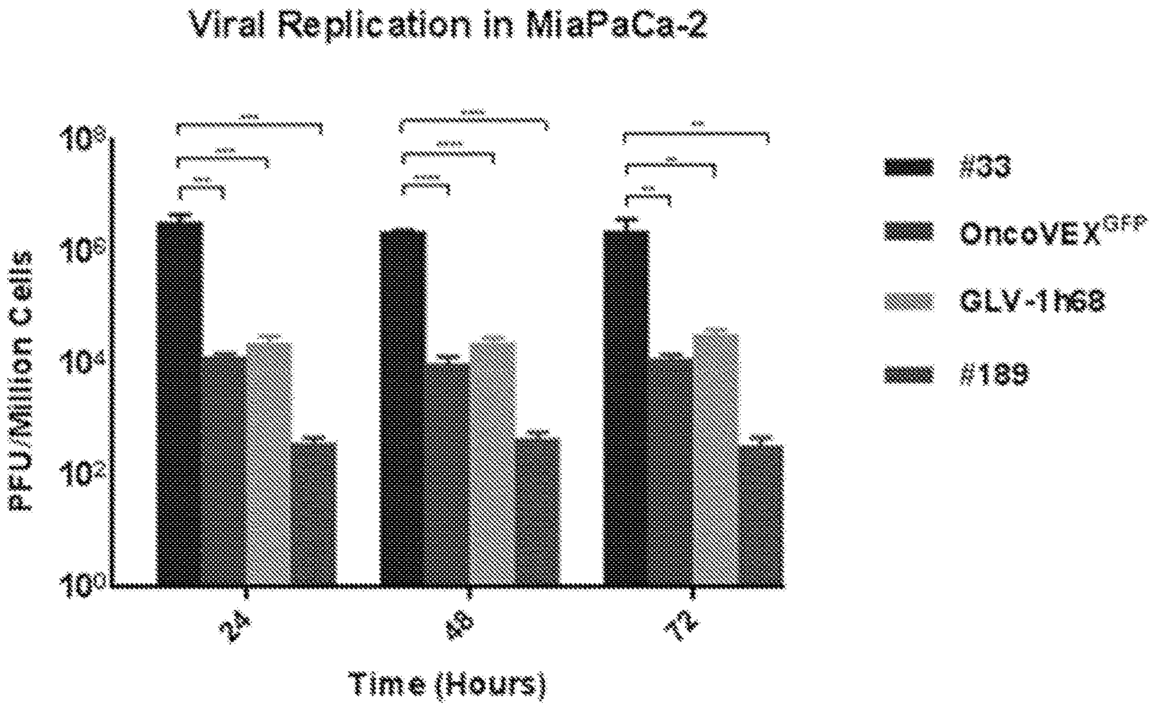
Figure 13E:
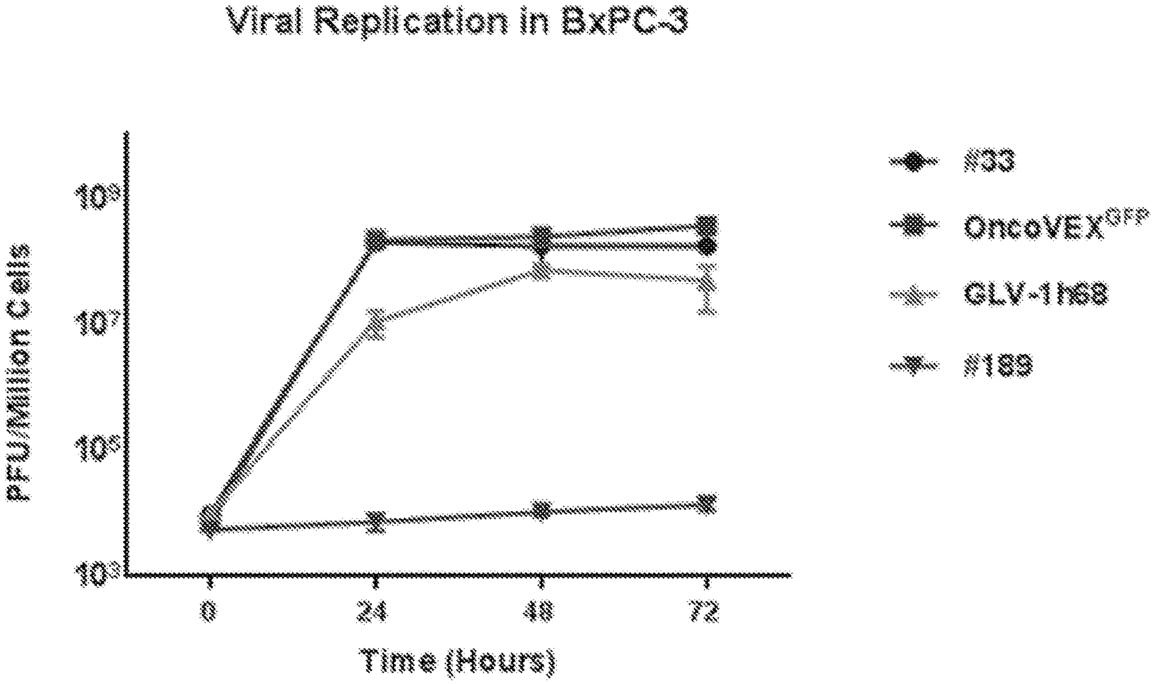
Figure 13F:
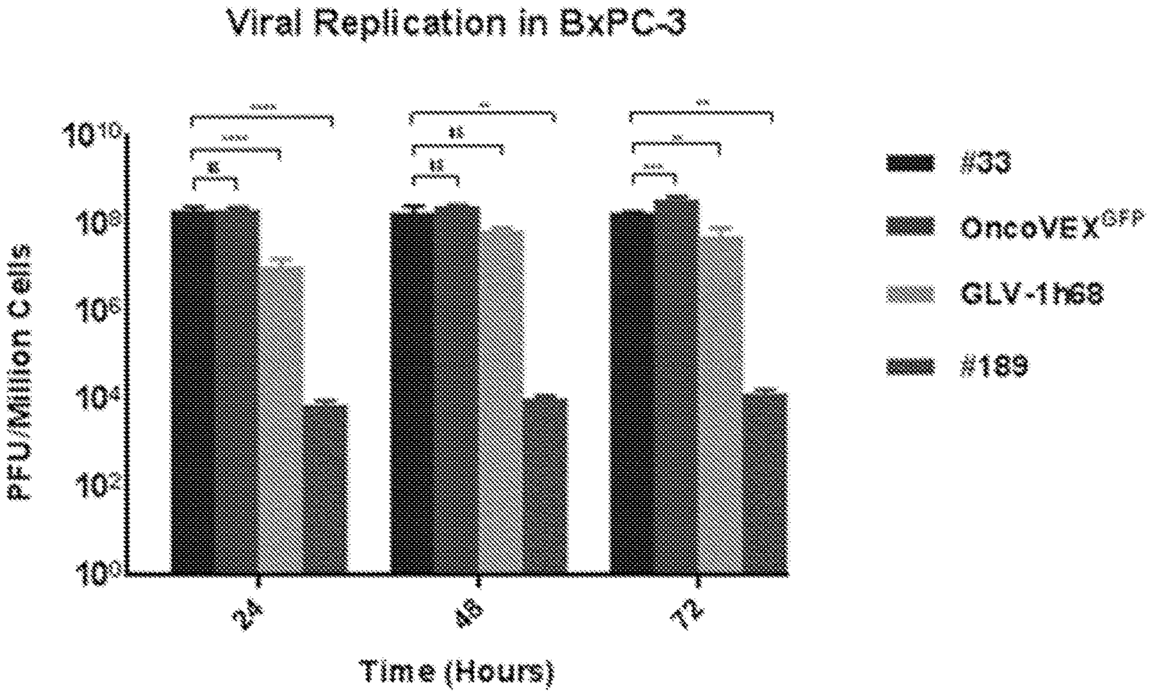
Figure 13G:
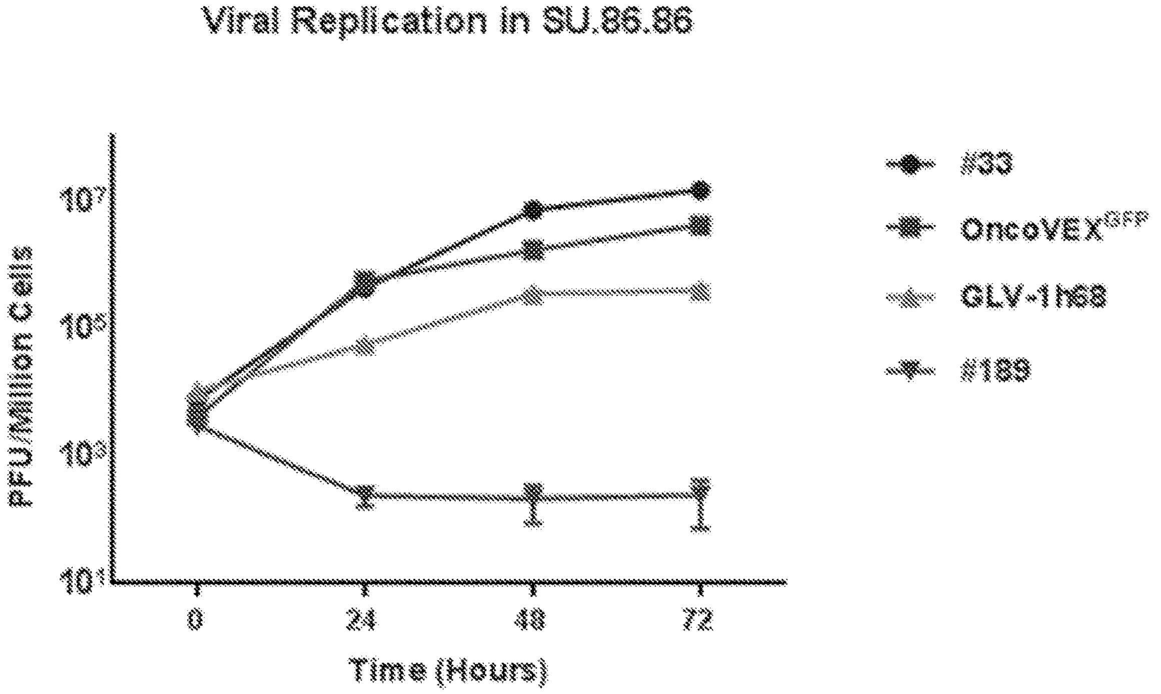
Figure 13H:
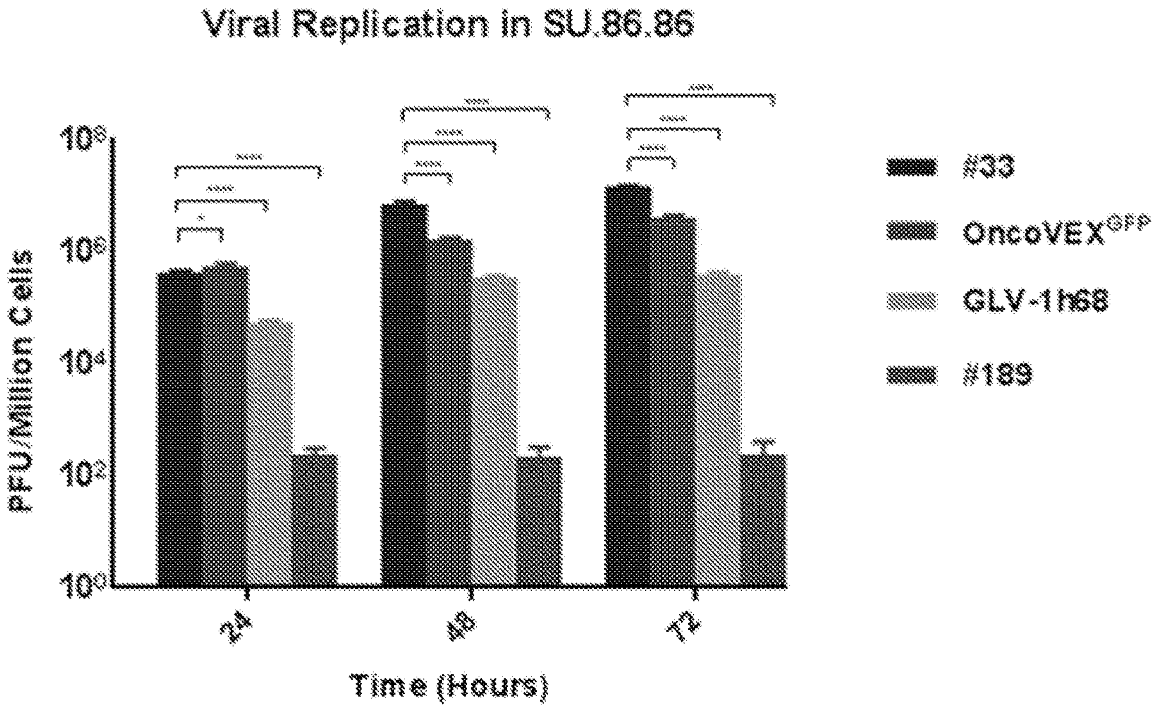
Figure 13I:
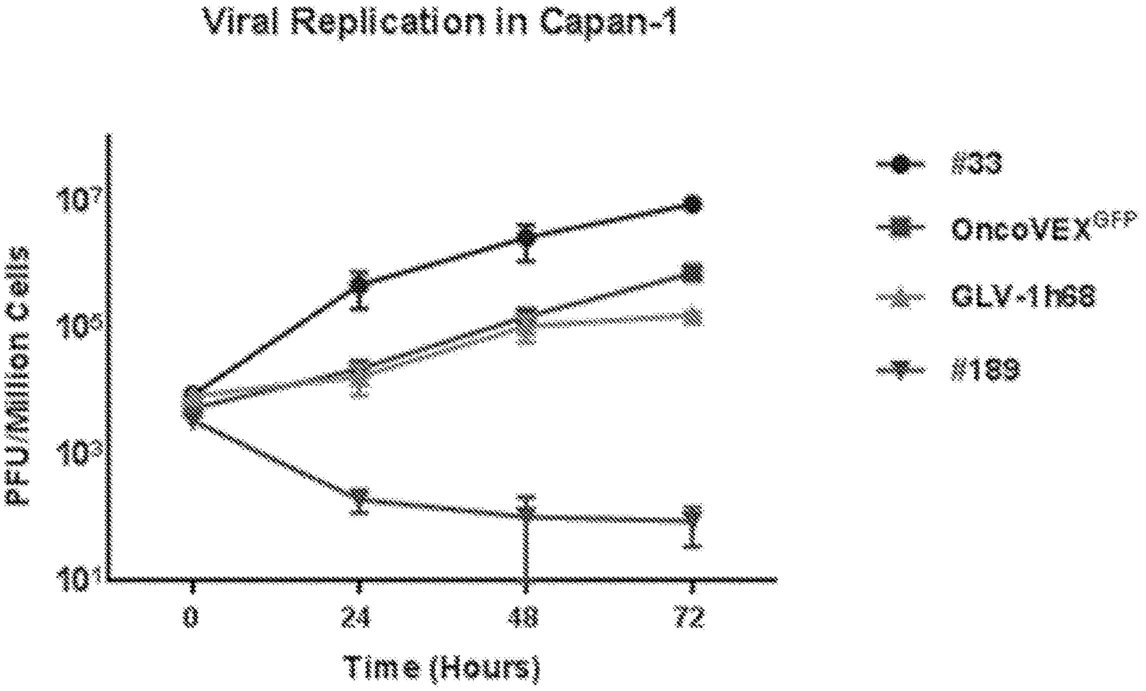
Figure 13J:
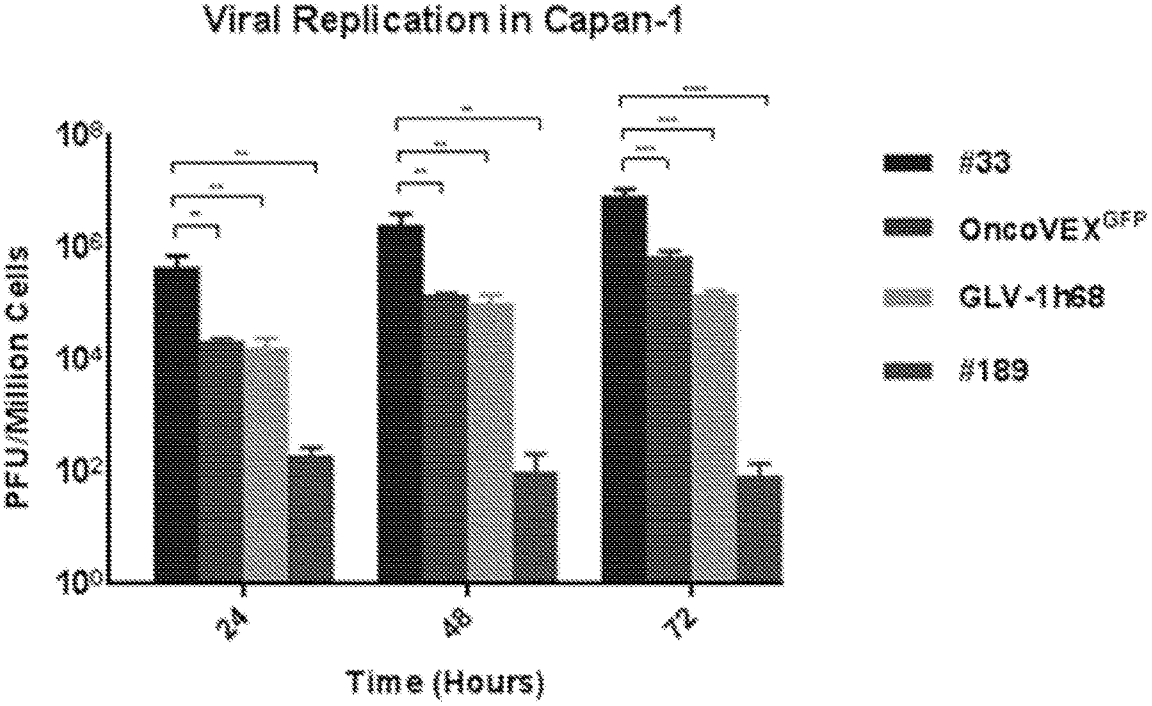
Figure 13K:
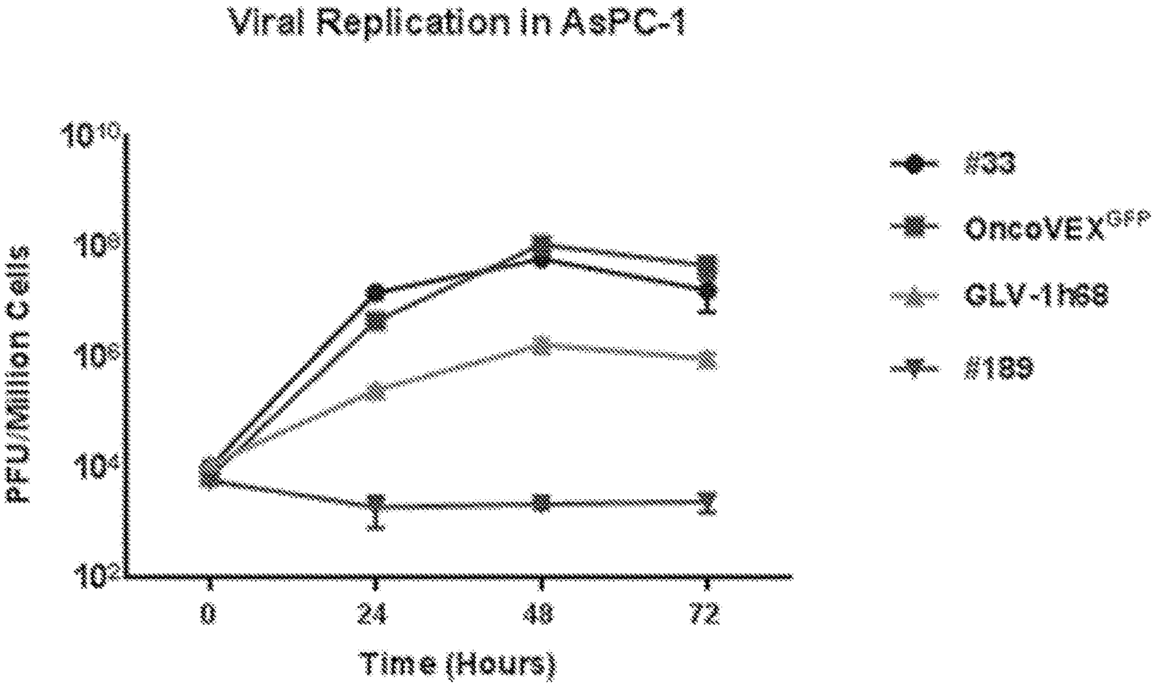
Figure 13L:
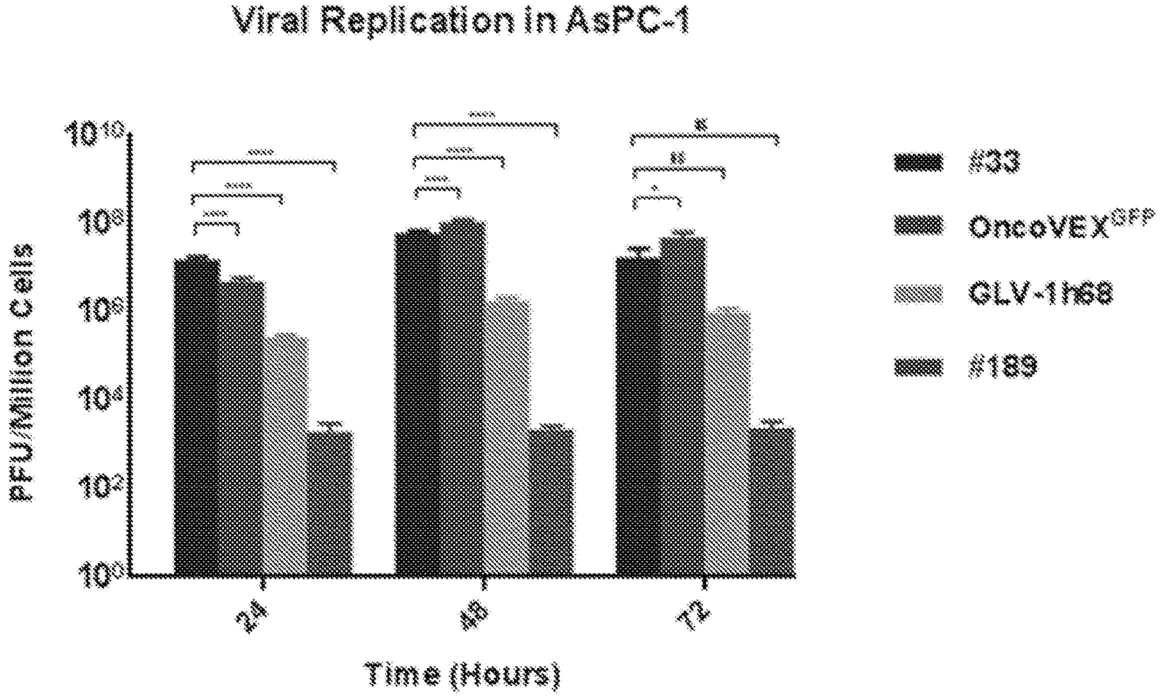

A viral replication curve was performed on cancer cell lines Panc-1 (FIGS. 13A-13B), MiaPaCa-2 (FIGS. 13C-13D), BxPC-3 (FIGS. 13E-13F), SU.86.86 (FIGS. 13G-13H), Capan-1 (FIGS. 131-134 and AsPC-1 (FIGS. 13K-13L) by plating cells at $5\times10^5$ cells per well in 2 mL RPMI 10% FBS, 1% Antibiotic-Antimycotic solution for 24 hours in triplicate. Media was then aspirated and #33, OncoVEX$^{GFP}$, GLV-1h68, or #189 was added at a multiplicity of infection (MOI) 0.01 in 500 uL RPMI 2.5% FBS, 1% Antibiotic-Antimycotic solution for 1 hour shaking every 20 minutes. At one hour, the media was aspirated and 1.5 mL of RPMI 2.5% FBS, 1% Antibiotic-Antimycotic solution was added. At 24, 48, and 72 hours, cells and supernatant were collected and after three freeze and thaw cycles, serial dilutions were performed in duplicate. This experiment was repeated in duplicate. Statistical analysis was performed comparing #33 to other experimental groups using One-Way ANOVA at each time point.

Treatment of Pancreatic Cancer Tumors In Vivo

Figure 14A:
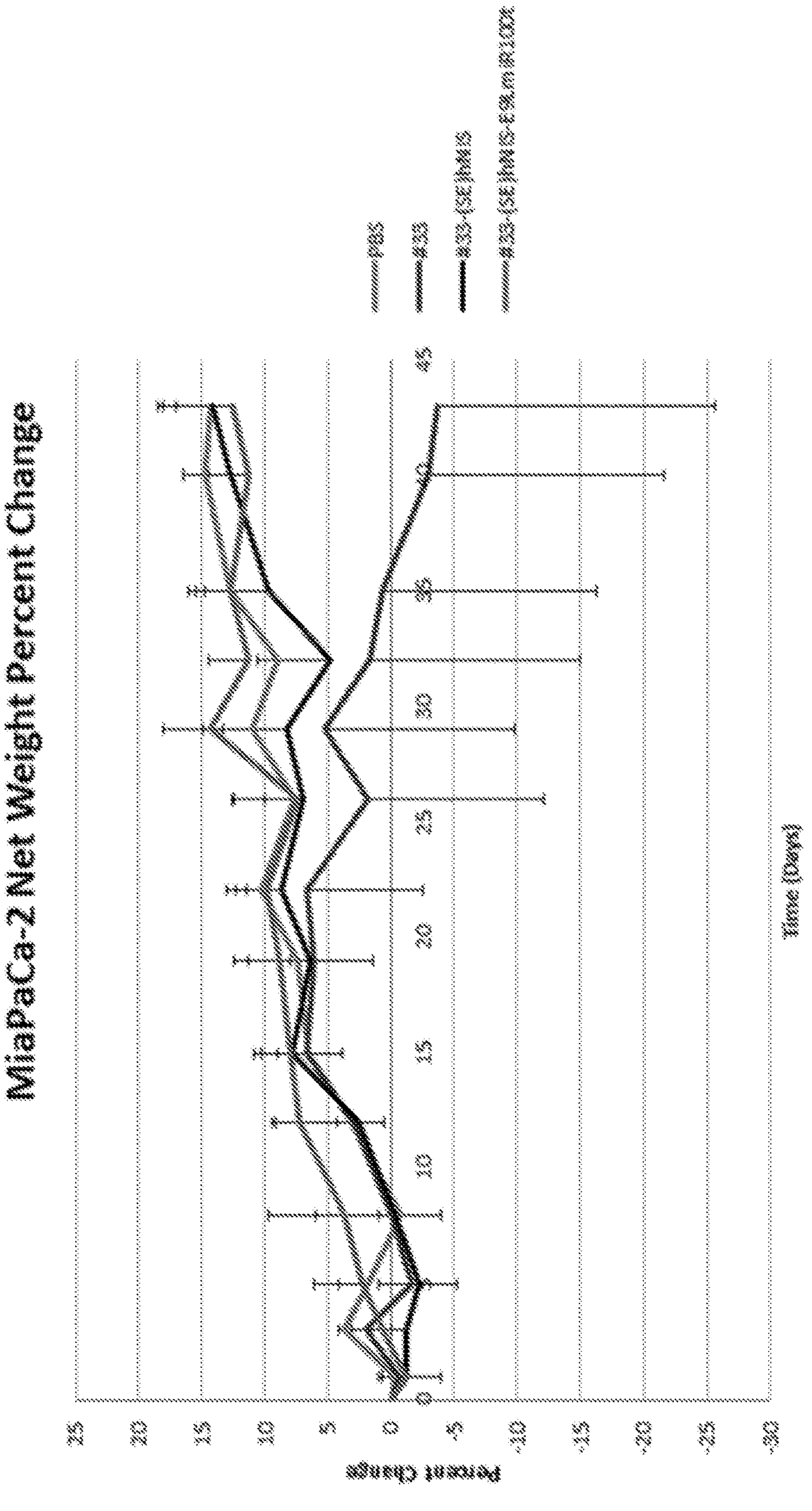
FIGS. 14A-14C. Eighteen athymic Nude-Foxn1$^{nu}$ female nude mice (Envigo, Indianapolis, IN) were implanted with $2\times10^6$ bilateral flank tumors of MiaPaCa-2. Once tumor dimensions reached 400 $mm^3$, the left sided tumor was injected with 50 μL of PBS (3 mice), #33 (5 mice), #33-(SE)hNIS, or #33-(SE)hNIS-E9LmiR100t (5 mice) at approximately $1\times10^5$ PFU/dose. Net percent weight change (FIG. 14A) and percent change (FIG. 14B) of the injected tumors and percent change of the non-injected tumors (FIG. 14C) were recorded twice weekly for 43 days.
Figure 14B:
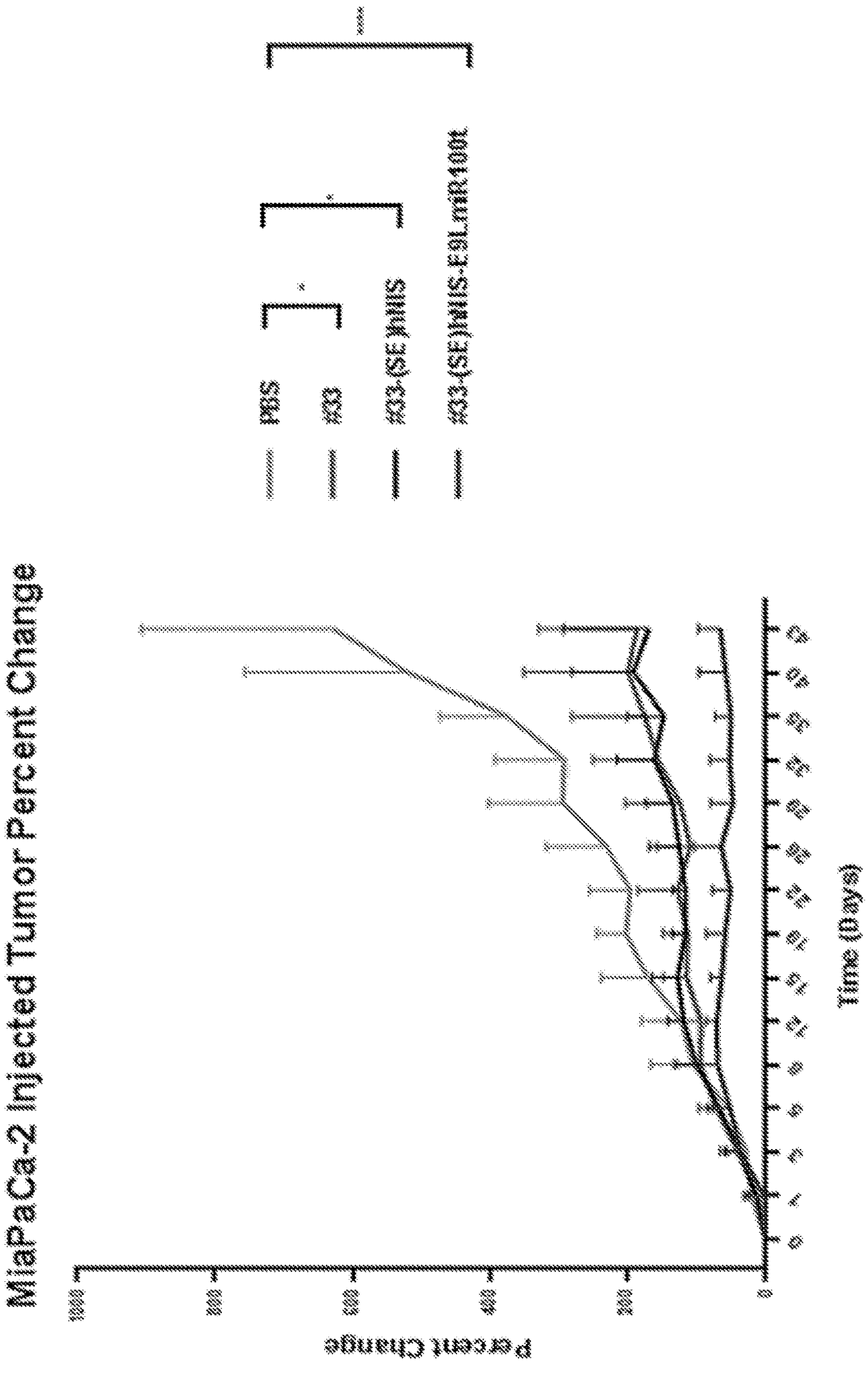
Figure 14C:
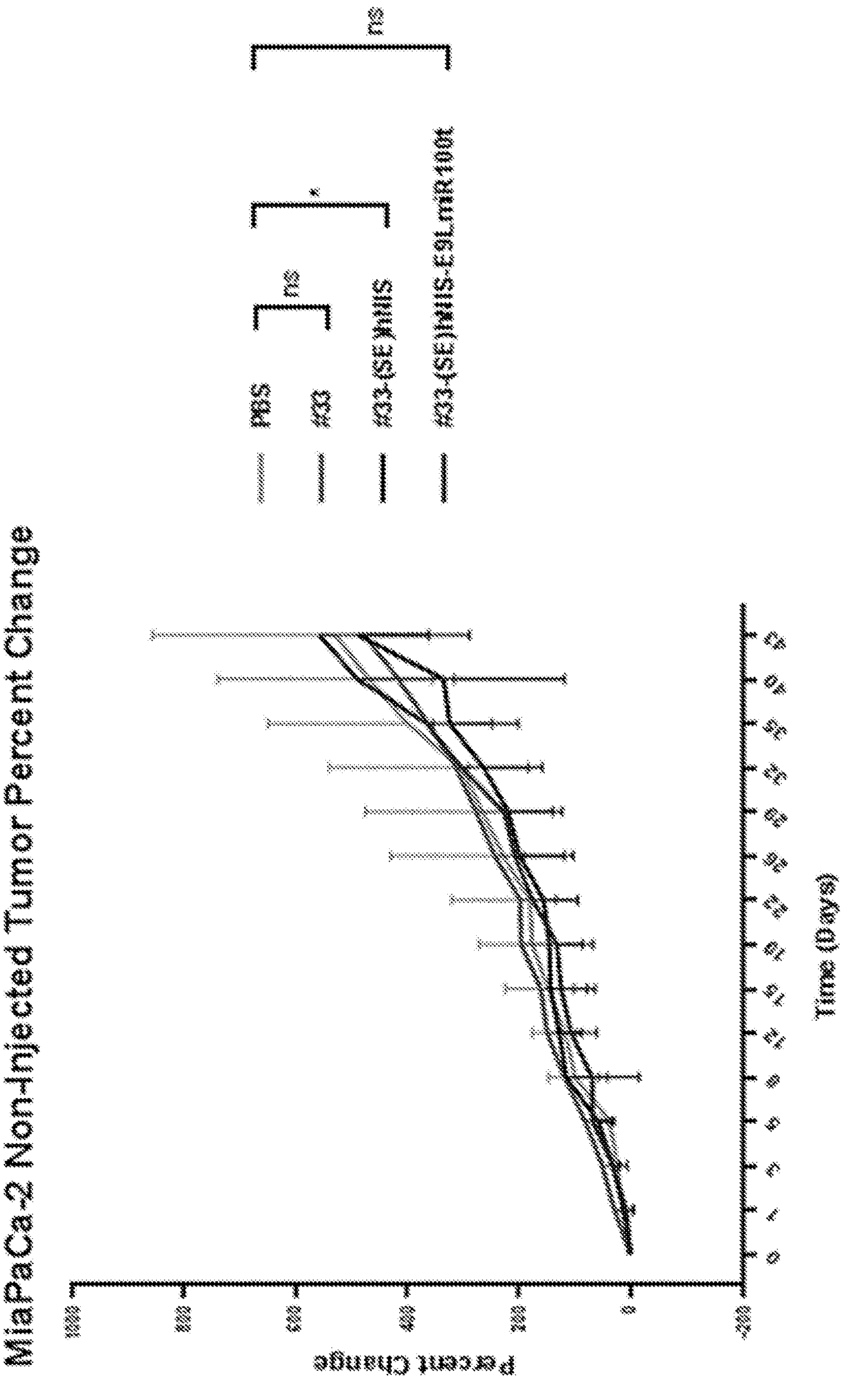

Eighteen Athymic Nude-Foxn1$^{nu}$ female nude mice (Envigo, Indianapolis, IN) were implanted with $2\times10^6$ bilateral flank tumors of MiaPaCa-2. Once tumor dimensions reached 400 $mm^3$, the left sided tumor was injected with 50 uL of PBS (3 mice), #33 (5 mice), #33-(SE)hNIS, or #33-(SE)hNIS-E9LmiR100t (5 mice) at approximately $1\times10^5$ PFU/dose. Actual dose of HOV-33 was $7.8\times10^4$. Actual dose of HOV-33-SE/hNIS was $4.5\times10^4$. Actual dose of HOV-33-SE/hNIS-E9L-miR100t was $1.6\times10^5$. Net percent weight change and percent change of the injected tumor and non-injected tumors were recorded twice weekly for 43 days (FIGS. 14A-14C). All mice were sacrificed at 43 days and viral titration was performed on the mouse organs. Significant differences in the injected tumor were noted when compared to PBS control with #33, #33-(SE)hNIS, and #33-(SE)hNIS-E9LmiR100t (FIG. 14B; p=0.01, p=0.01, and p=0.0001 respectively). Significant differences were only noted in the non-injected tumor groups between PBS control and #33-(SE)hNIS (FIG. 14C; p=0.03).

Figure 15A:
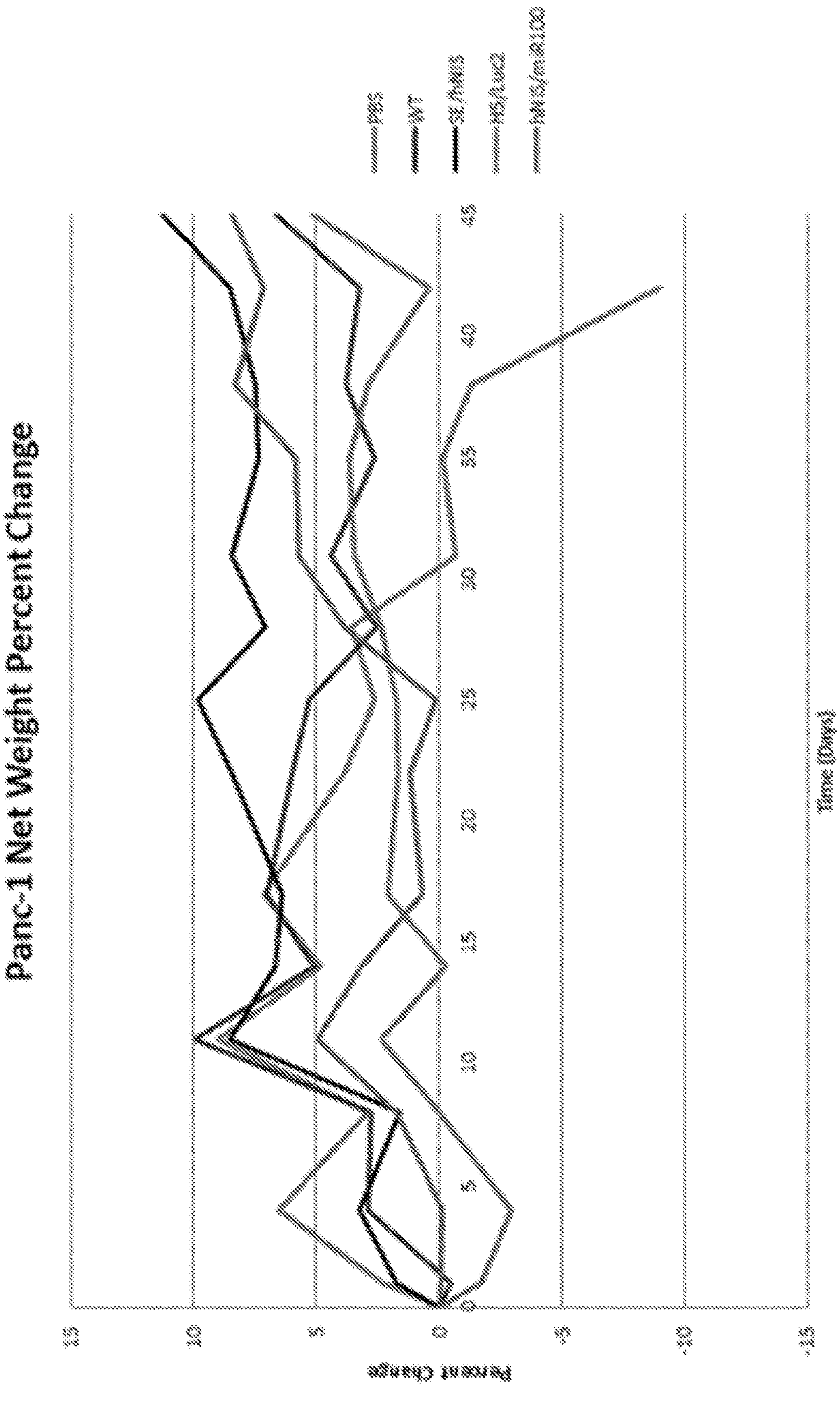
FIGS. 15A-15C. Twenty-six athymic Nude-Foxn1$^{nu}$ female nude mice (Envigo, Indianapolis, IN) were implanted with $1.25\times10^6$ bilateral flank tumors of PANC-1. Once tumor dimensions reached approximately 250 $mm^3$, the left sided tumor was injected with 50 μL of PBS (4 mice), #33 (6 mice), #33-(SE)hNIS (6 mice), #33-(SE)hNIS-E9LmiR100t (5 mice), or #33-(H5)Fluc2 at approximately $1\times10^3$ PFU/dose. Net percent weight change (FIG. 15A) and percent change (FIG. 15B) of the injected tumors and percent change of the non-injected tumors (FIG. 15C) were recorded twice weekly for 43 days.
Figure 15B:
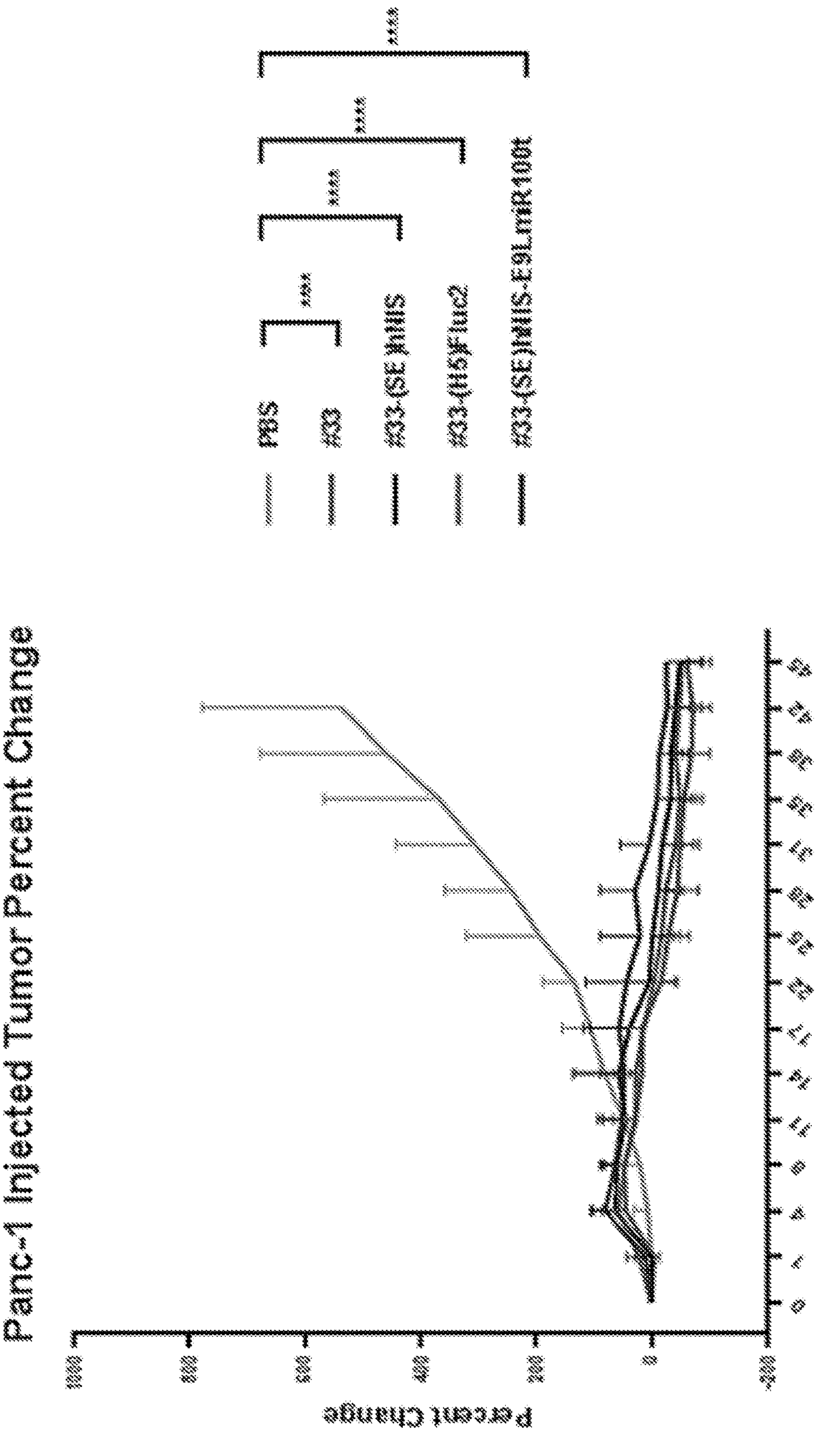
Figure 15C:
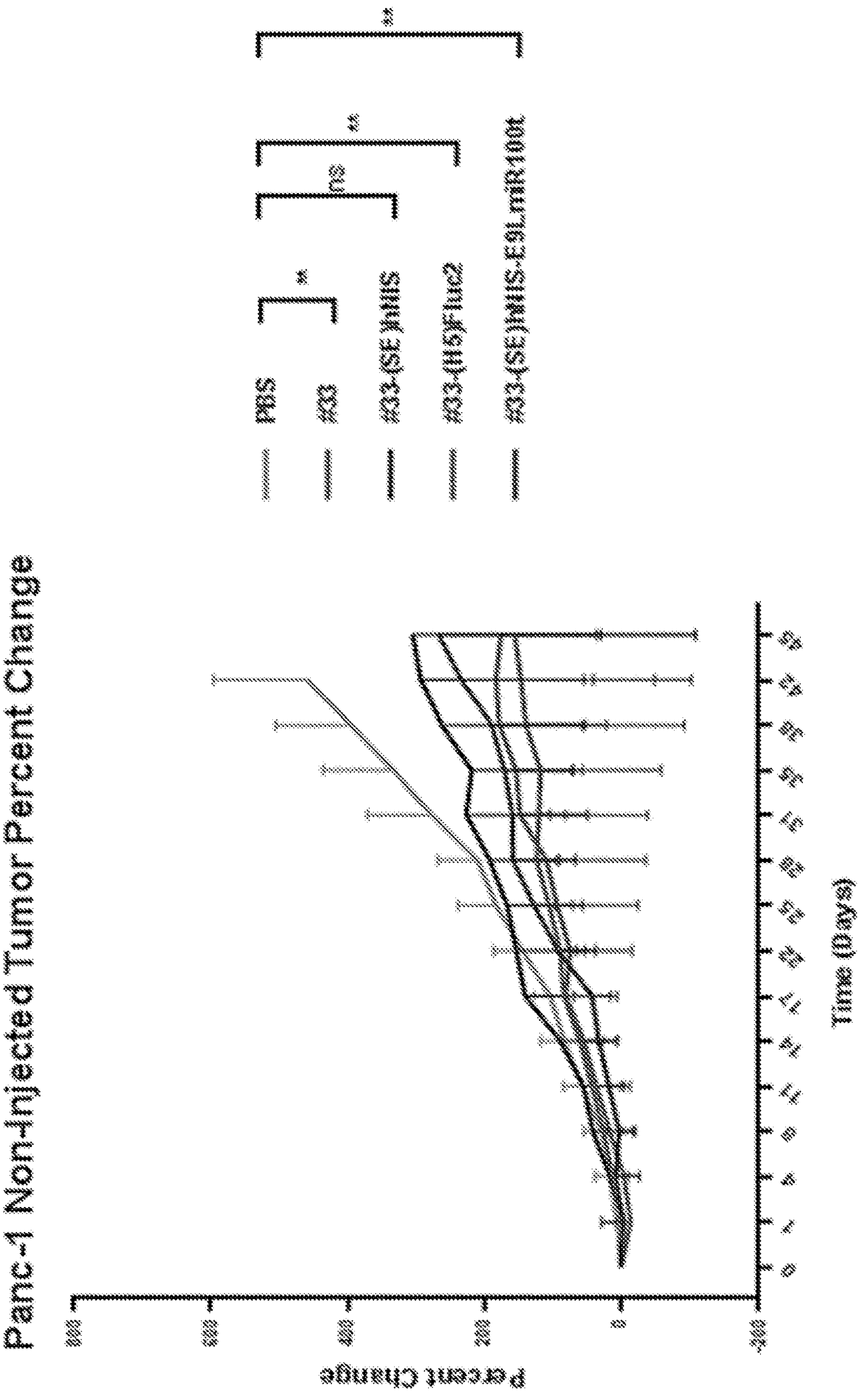

Twenty-six athymic Nude-Foxn1$^{nu}$ female nude mice (Envigo, Indianapolis, IN) were implanted with $1.25\times10^6$ bilateral flank tumors of Panc-1. Once tumor dimensions reached approximately 250 $mm^3$, the left sided tumor was injected with 50 uL of PBS (4 mice), #33 (6 mice), #33-(SE)hNIS (6 mice), #33-(SE)hNIS-E9LmiR100t (5 mice), or #33-(H5)Fluc2 at approximately $1\times10^3$ PFU/dose. Actual dose of HOV-33 was $8.6\times10^2$. Actual dose of HOV-33-SE/hNIS was $6.3\times10^2$. Actual dose of HOV-33-H5Fluc was $1\times10^4$.Actual dose of HOV-33-SE/hNIS-E9L-miR100t was $1.0\times10^3$. Net percent weight change and percent change of the injected and non-injected tumors were recorded twice weekly for 43 days (FIGS. 15A-15C). All mice were sacrificed at 45 days. Significant differences in the injected tumor percent change in volume were noted when compared to PBS control in all groups (FIG. 15B; p=0.0001). Significant differences in the non-injected tumor were noted when compared to PBS control with #33, #33-(H5)Fluc2, and #33-(SE)hNIS-E9LmiR100t (FIG. 15C; p=0.003, p=0.008, p=0.002, respectively).

Figure 16:
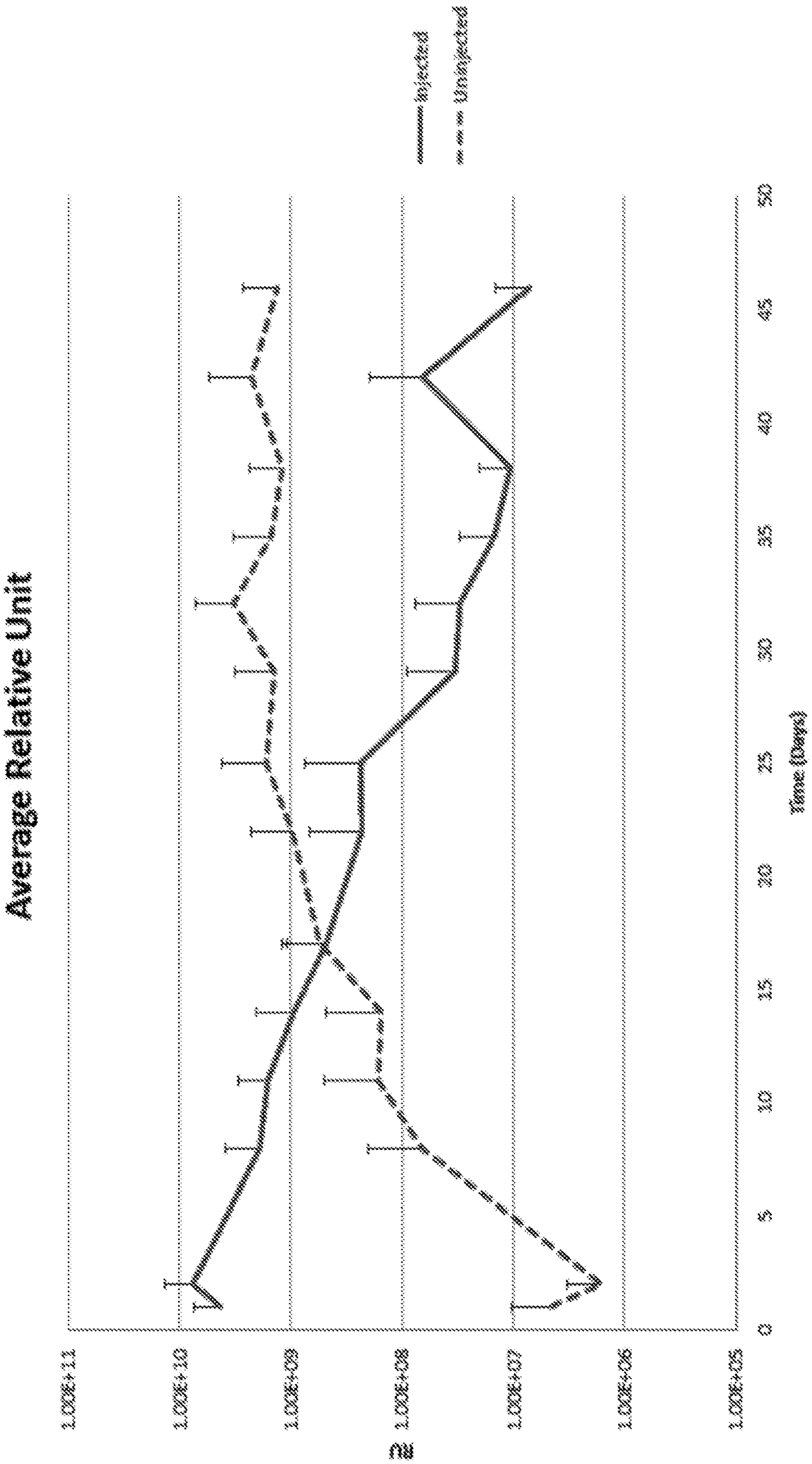
FIG. 16. Twice per week, one PBS control mouse and 3 #33-(H5)Fluc2 injected mice were injected with 4.28 mg luciferin in 150 μL of PBS intraperitoneally. After 7 minutes, luciferase imaging was obtained at a standard exposure. The relative unit was recorded at each time point and analyzed relative to the PBS control mice as a background.

Twice per week, one PBS control mouse and 3 #33-(H5)Fluc2 injected mice were injected with 4.28 mg luciferin in 150 μL of PBS intraperitoneally. After 7 minutes, luciferase imaging was obtained at a standard exposure. The relative unit was recorded at each time point and analyzed relative to the PBS control mice as a background (FIG. 16).

Example 8. Targeting Colon Cancer with Oncolytic Virotherapy

Cytotoxicity Assay

Figure 17A:
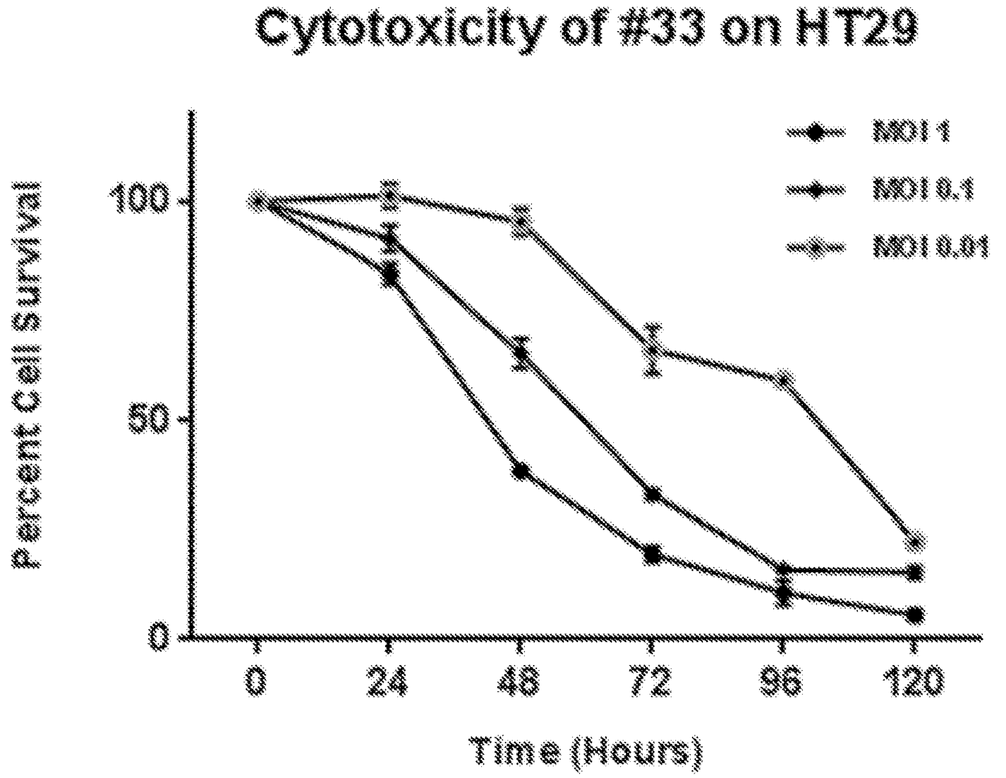
FIGS. 17A-17D. A cytotoxicity assay was performed on HT-29 and HCT-116 cancer cell lines by plating cells at $3\times10^3$ per well in 100 μL McCoy's 5A Media, 5% FBS, 1% Antibiotic-Antimycotic solution for 24 hours. 20 μL of the virus, either #33, #33-(SE)hNIS, #33-(H5)Emerald, OncoVEX$^{GFP}$, GLV-1h68, or #189, was then added at a multiplicity of infection (MOI) of 1, 0.1, and 0.01. A daily cell viability assay was performed by adding 20 μL of CELLTITER 96™ Aqueous One Solution Cell Proliferation Assay to all wells and taking a colorimetric reading after 1 hour of incubation. Experimental results were standardized to a media only and MOI 0 control. This experiment was repeated in triplicate. Presented are graphs showing percent cell survival over time for HT-29 (FIG. 17A) and HCT-116 (FIG. 17C) treated with #33 at a MOI of 1, 0.1, or 0.01. Also presented are bar graphs comparing percent cell survival at 120 hours for HT-29 (FIG. 17B) and HCT-116 (FIG. 17D) cancer cells treated with virus as indicated. Statistical analysis was performed comparing #33 to other experimental groups using One-Way ANOVA at each time point.
Figure 17B:
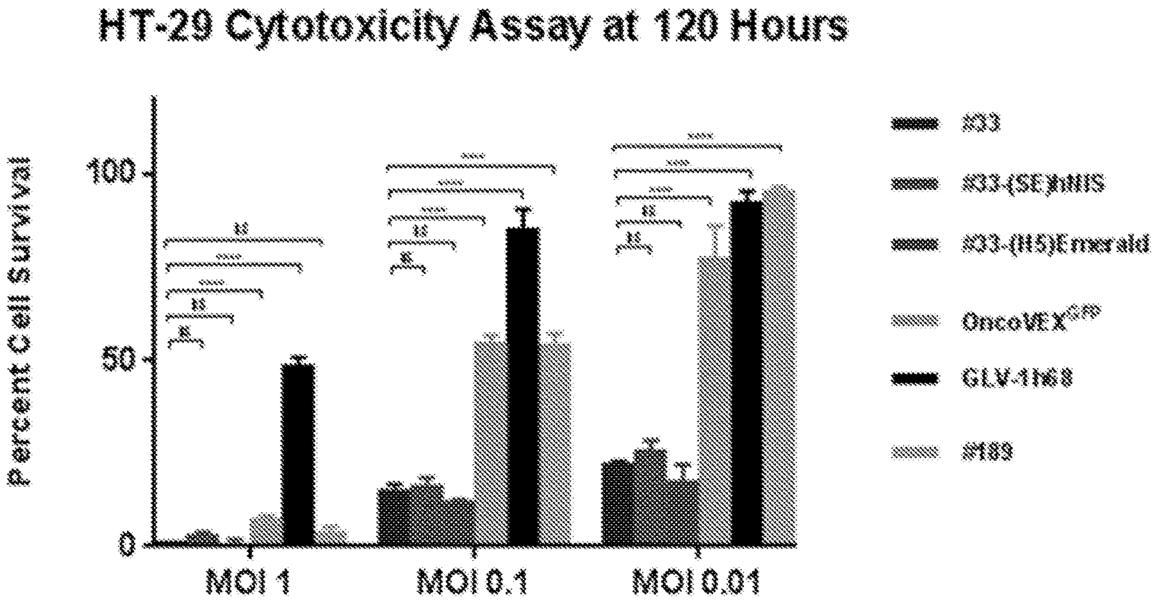
Figure 17C:
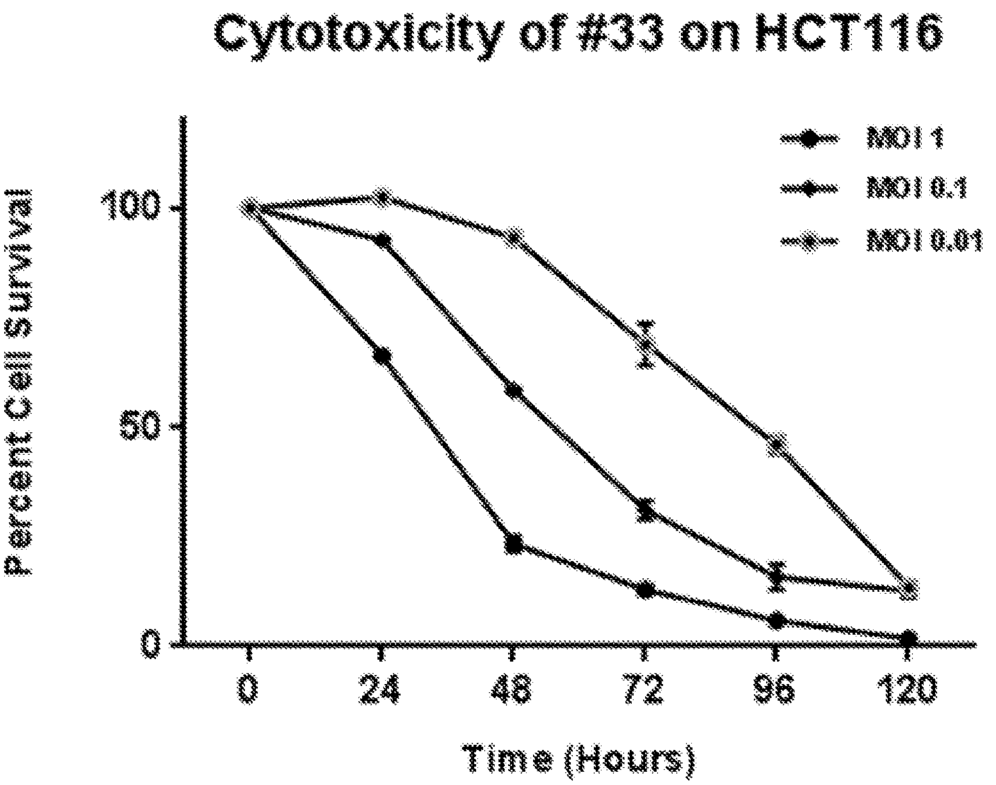
Figure 17D:
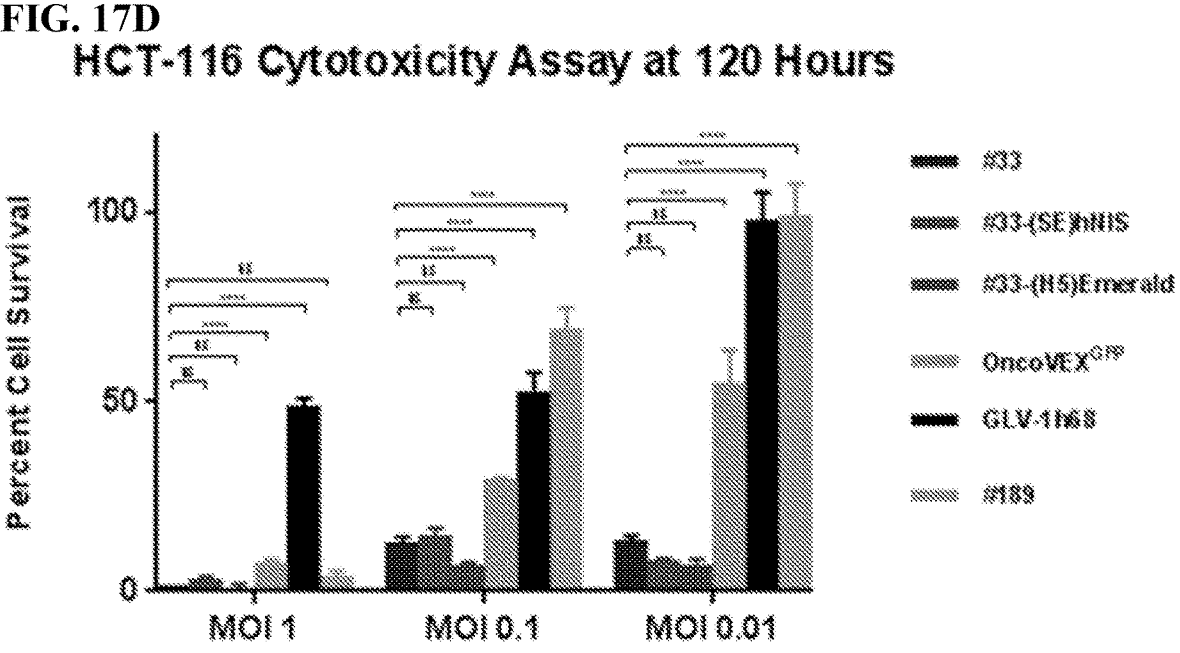

A cytotoxicity assay was performed on HT-29 (FIGS. 17A-17B) and HCT-116 (FIGS. 17C-17D) cancer cell lines by plating cells at $3\times10^3$ per well in 100 μL McCoy's 5A Media, 5% FBS, 1% Antibiotic-Antimycotic solution for 24 hours. 20 μL of the virus, either #33, OncoVEX$^{GFP}$, GLV-1h68, or #189, was then added at a multiplicity of infection (MOI) of 1, 0.1, and 0.01. A daily cell viability assay was performed by adding 20 μL of CELLTITER 96™ Aqueous One Solution Cell Proliferation Assay to all wells and taking a colorimetric reading after 1 hour of incubation. Experimental results were standardized to a media only and MOI 0 control. This experiment was repeated in triplicate. Statistical analysis was performed comparing #33 to other experimental groups using One-Way ANOVA at each time point.

Figure 18A:
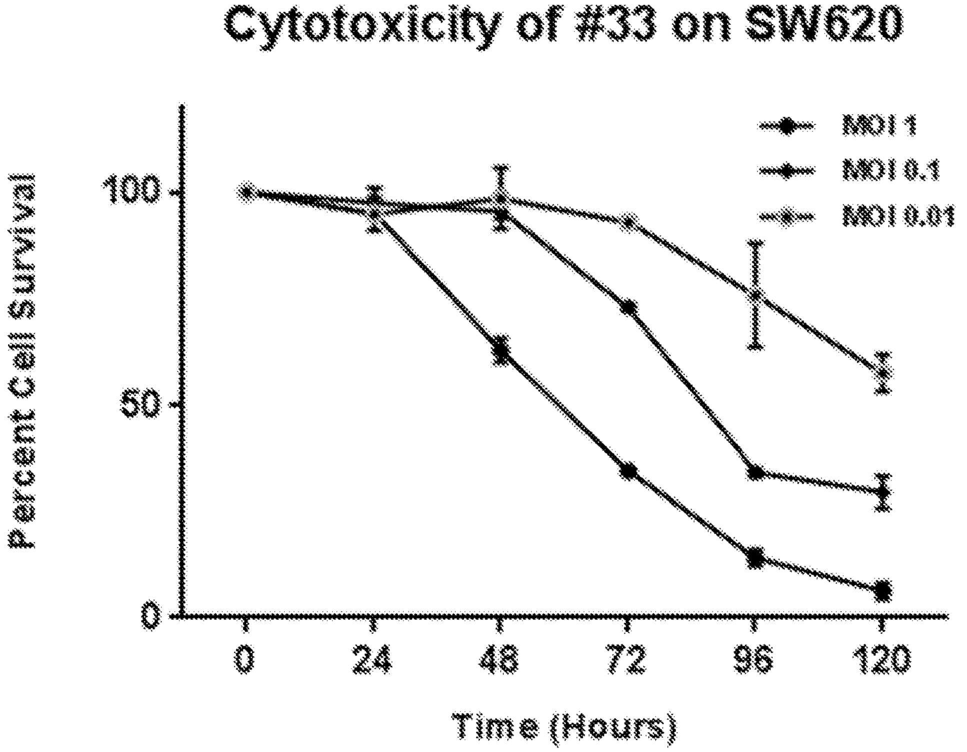
FIGS. 18A-18F. A cytotoxicity assay was performed on SW620, SW480, and COLO 320DM cancer cell lines by plating cells at $3\times10^3$ per well in 100 μL RPMI, 5% FBS, 1% Antibiotic-Antimycotic solution for 24 hours. 20 μL of the virus, either #33, #33-(SE)hNIS, #33-(H5)Emerald, OncoVEX$^{GFP}$, GLV-1h68, or #189, was then added at a multiplicity of infection (MOI) of 1, 0.1, and 0.01. A daily cell viability assay was performed by adding 20 μL of CELLTITER 96™ Aqueous One Solution Cell Proliferation Assay to all wells and taking a colorimetric reading after 1 hour of incubation. Experimental results were standardized to a media only and MOI 0 control. This experiment was repeated in triplicate. Presented are graphs showing percent cell survival over time for SW620 (FIG. 18A), SW480 (FIG. 18C), and COLO 320DM (FIG. 18E) treated with #33 at a MOI of 1, 0.1, or 0.01. Also presented are bar graphs comparing percent cell survival at 120 hours for SW620 (FIG. 18B), SW480 (FIG. 18D), and COLO 320DM (FIG. 18F) cancer cells treated with virus as indicated. Statistical analysis was performed comparing #33 to other experimental groups using One-Way ANOVA at each time point. "NS" above comparison bar means "not significant.
Figure 18B:
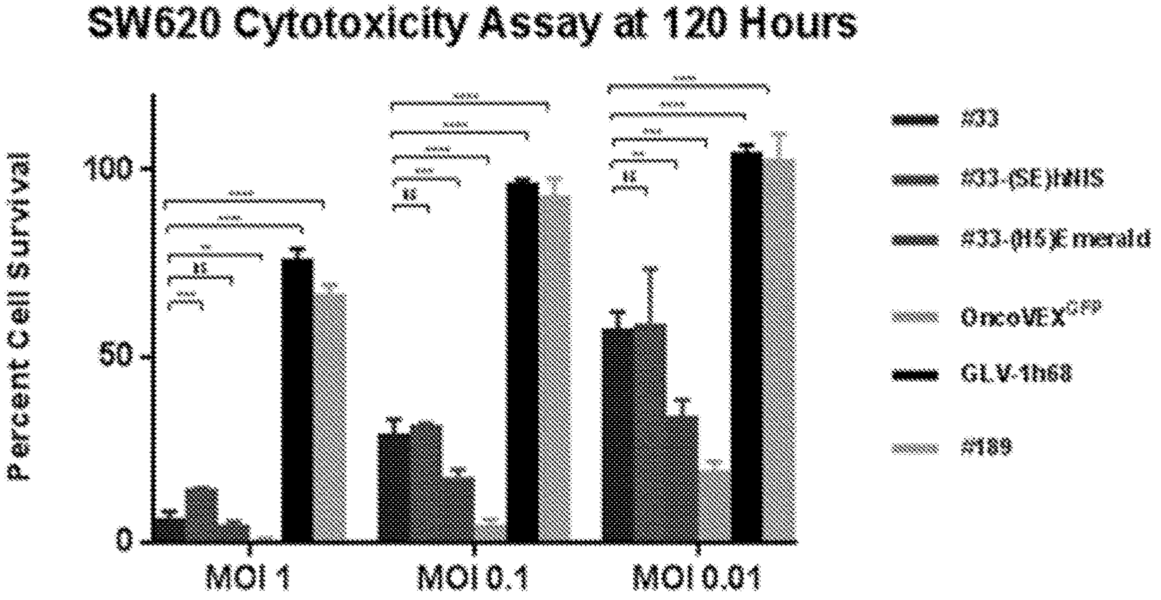
Figure 18C:
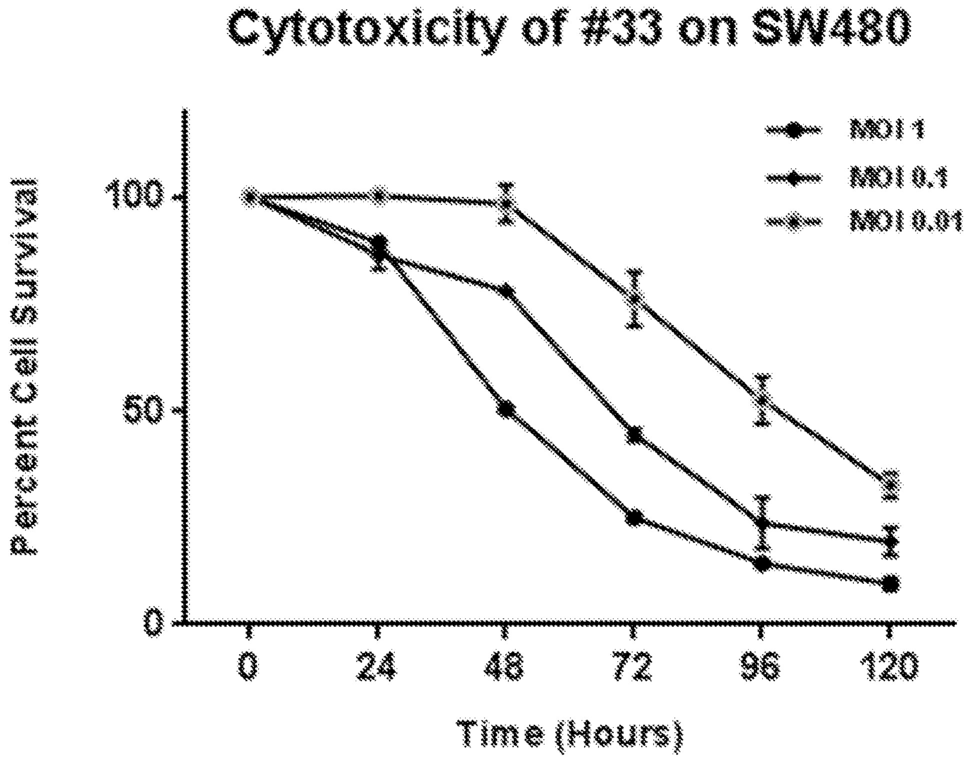
Figure 18D:
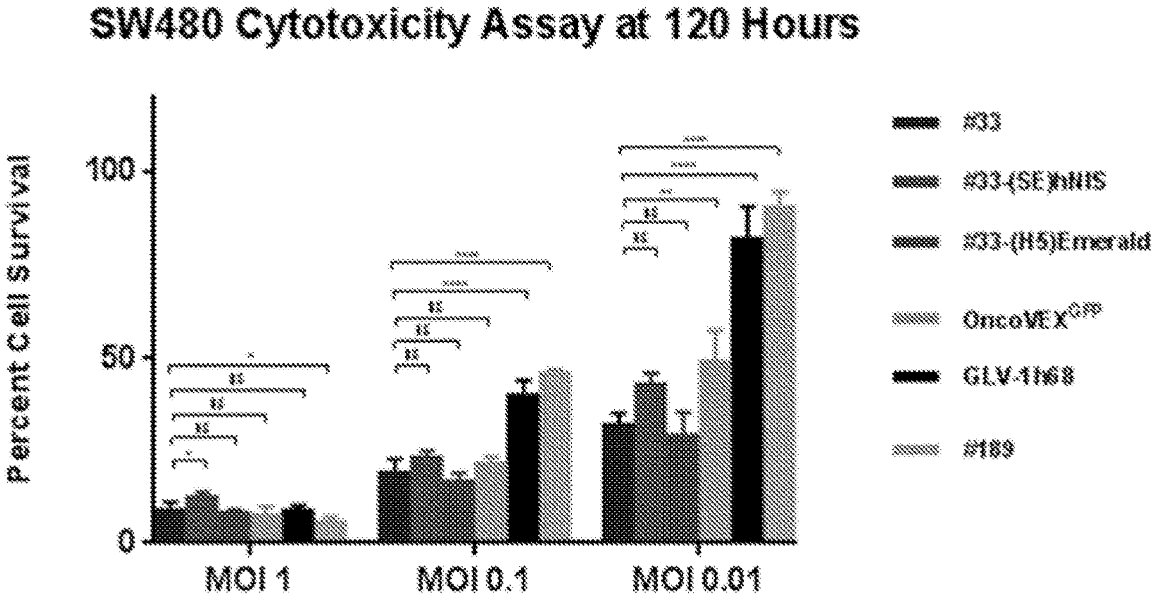
Figure 18E:
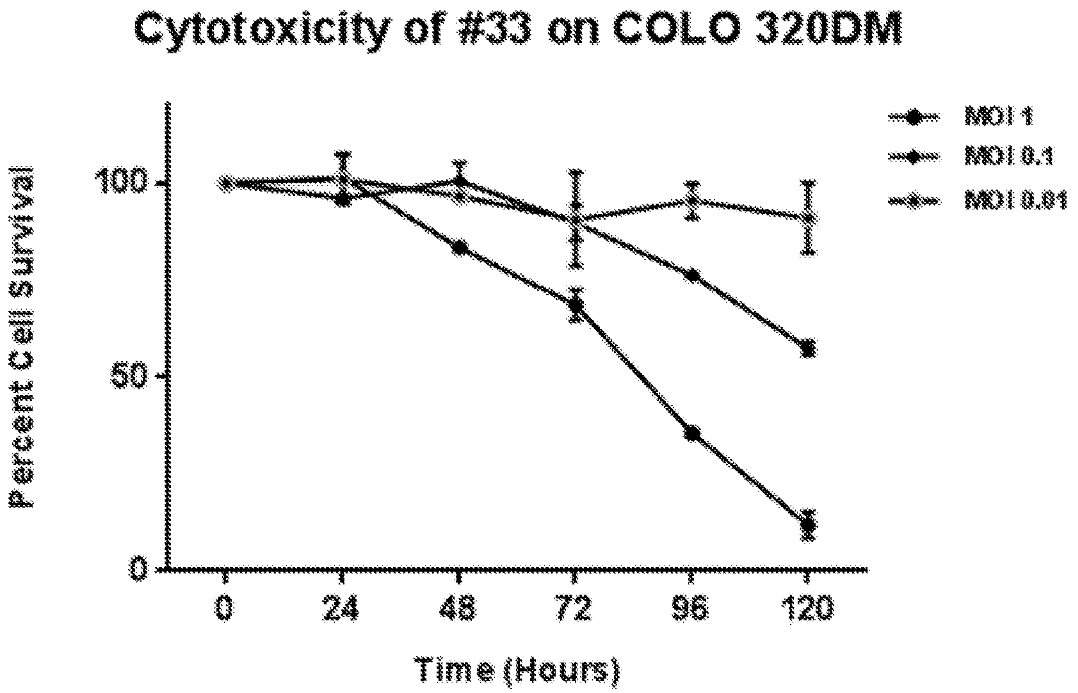
Figure 18F:
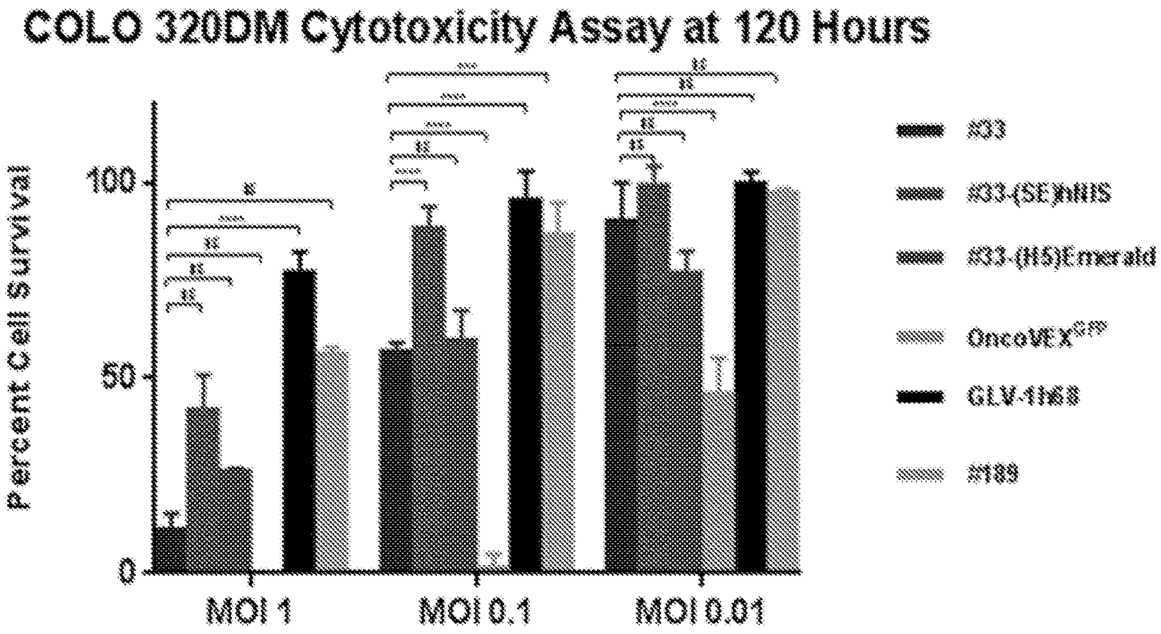

A cytotoxicity assay was performed on SW620 (FIGS. 18A-18B), SW480 (FIGS. 18C-18D), and COLO 320DM (FIGS. 18E-F) cancer cell lines by plating cells at $3\times10^3$ per well in 100 μL RPMI, 5% FBS, 1% Antibiotic-Antimycotic solution for 24 hours. 20 μL of the virus, either #33, OncoVEX$^{GFP}$, GLV-1h68, or #189, was then added at a multiplicity of infection (MOI) of 1, 0.1, and 0.01. A daily cell viability assay was performed by adding 20 uL of CELLTITER 96™ Aqueous One Solution Cell Proliferation Assay to all wells and taking a colorimetric reading after 1 hour of incubation. Experimental results were standardized to a media only and MOI 0 control. This experiment was repeated in triplicate. Statistical analysis was performed comparing #33 to other experimental groups using One-Way ANOVA at each time point.

Figure 19A:
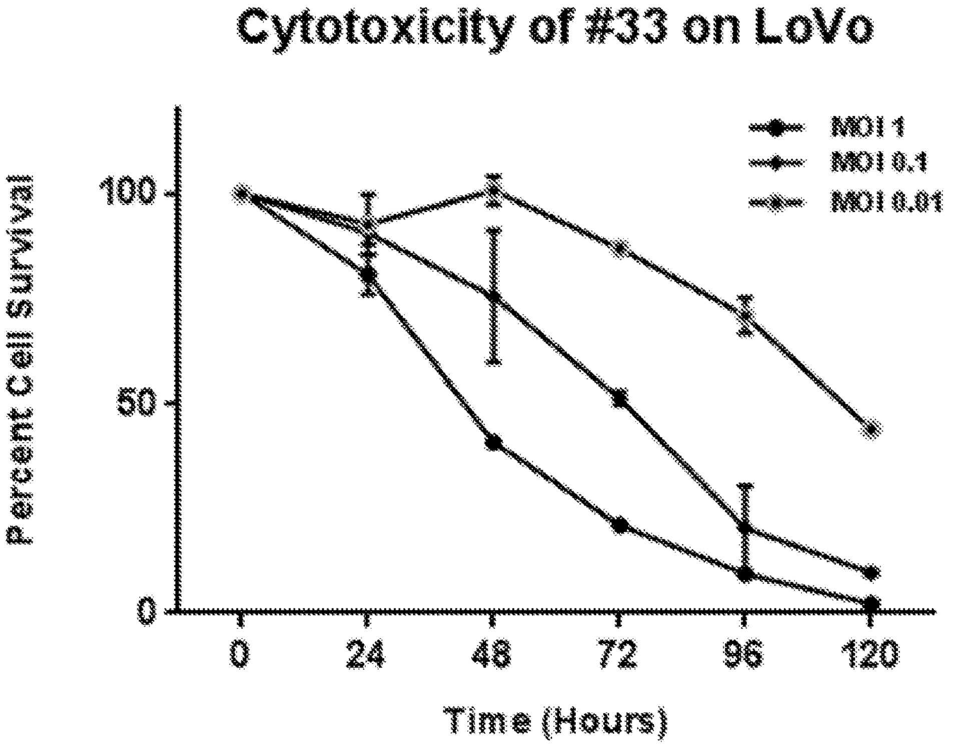
FIG. 19A-19B. A cytotoxicity assay was performed on the LoVo cancer cell line by plating cells at $3\times10^3$ per well in 100 μL F-12K media, 5% FBS, 1% Antibiotic-Antimycotic solution for 24 hours. 20 μL of the virus, either #33, #33-(SE)hNIS, #33-(H5)Emerald, OncoVEX$^{GFP}$, GLV-1h68, or #189, was then added at a multiplicity of infection (MOI) of 1, 0.1, and 0.01. A daily cell viability assay was performed by adding 20 μL of CELLTITER 96™ Aqueous One Solution Cell Proliferation Assay to all wells and taking a colorimetric reading after 1 hour of incubation. Experimental results were standardized to a media only and MOI 0 control. This experiment was repeated in triplicate.
Figure 19B:
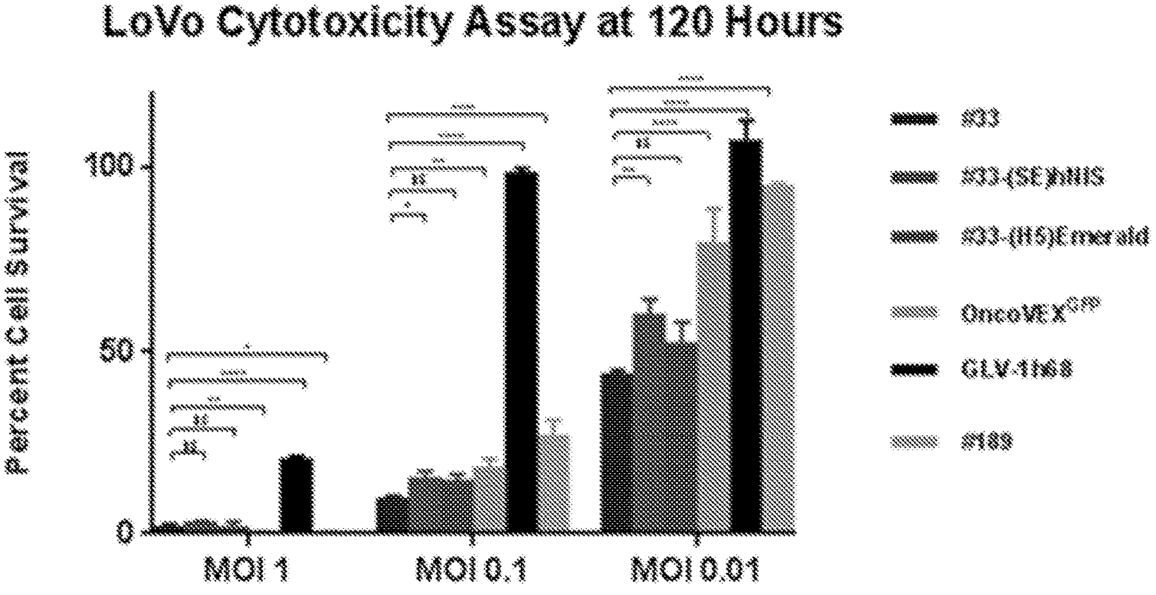

A cytotoxicity assay was performed on the LoVo (FIGS. 19A-19B) cancer cell line by plating cells at $3\times10^3$ per well in 100 μL F-12K media, 5% FBS, 1% Antibiotic-Antimycotic solution for 24 hours. 20 μL of the virus, either #33, OncoVEX$^{GFP}$, GLV-1h68, or #189, was then added at a multiplicity of infection (MOI) of 1, 0.1, and 0.01. A daily cell viability assay was performed by adding 20 μL of CELLTITER 96™ Aqueous One Solution Cell Proliferation Assay to all wells and taking a colorimetric reading after 1 hour of incubation. Experimental results were standardized to a media only and MOI 0 control. This experiment was repeated in triplicate. Statistical analysis was performed comparing #33 to other experimental groups using One-Way ANOVA at each time point.

Viral Growth Curve

Figure 20A:
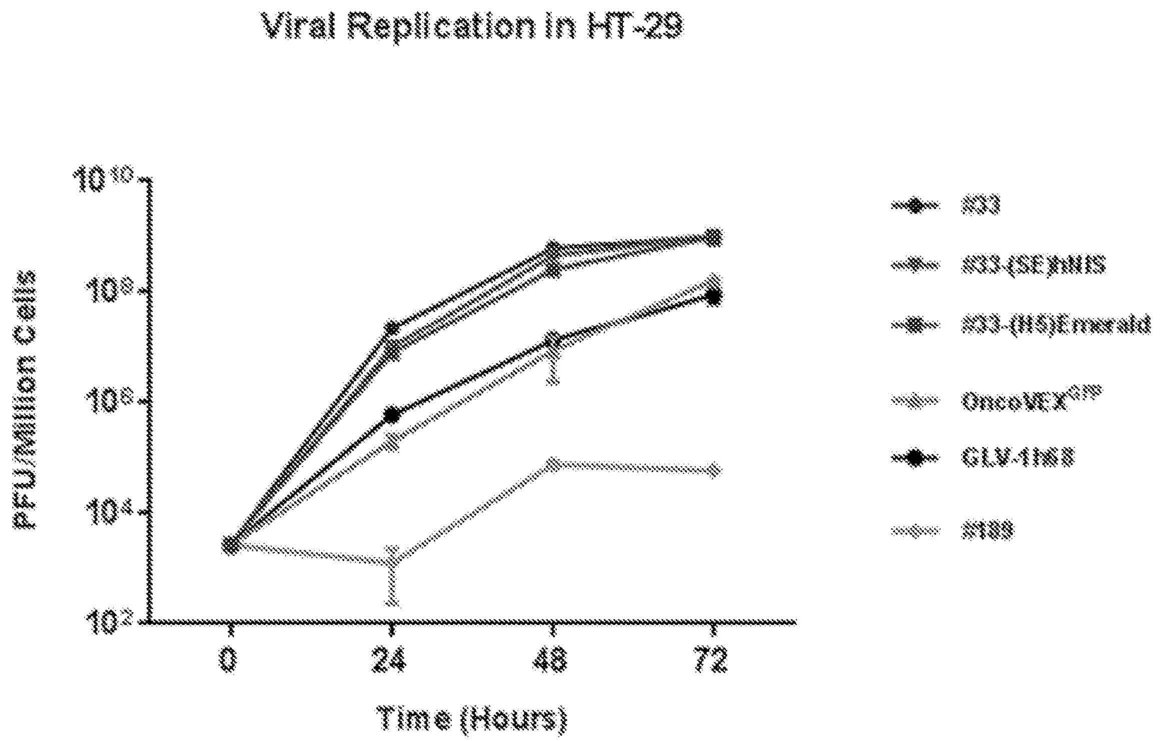
FIGS. 20A-20D. A viral replication curve was performed on HT-29 and HCT-116 cancer cell lines by plating cells at $5\times10^5$ cells per well in 2 mL McCoy's 5A media, 10% FBS, 1% Antibiotic-Antimycotic solution for 24 hours in triplicate. Media was then aspirated and #33, #33-(SE)hNIS, #33-(H5)Emerald, OncoVEX$^{GFP}$, GLV-1h68, or #189 was added at a multiplicity of infection (MOI) 0.01 in 500 μL McCoy's 5A media, 2.5% FBS, 1% Antibiotic-Antimycotic solution for 1 hour shaking every 20 minutes. At one hour, the media was aspirated and 1.5 mL of McCoy's 5A media, 2.5% FBS, 1% Antibiotic-Antimycotic solution was added. At 24, 48, and 72 hours, cells and supernatant were collected and after three freeze and thaw cycles, serial dilutions were performed in duplicate. This experiment was repeated in duplicate. Presented are graphs showing PFU/Million cells over time for HT-29 (FIG. 20A) and HCT-116 (FIG. 20C). Also presented are bar graphs comparing PFU/Million cells at each time point for each virus in HT-29 (FIG. 20B) and HCT-116 (FIG. 20D) treated cancer cells. Statistical analysis was performed comparing #33 to other experimental groups using One-Way ANOVA at each time point.
Figure 20B:
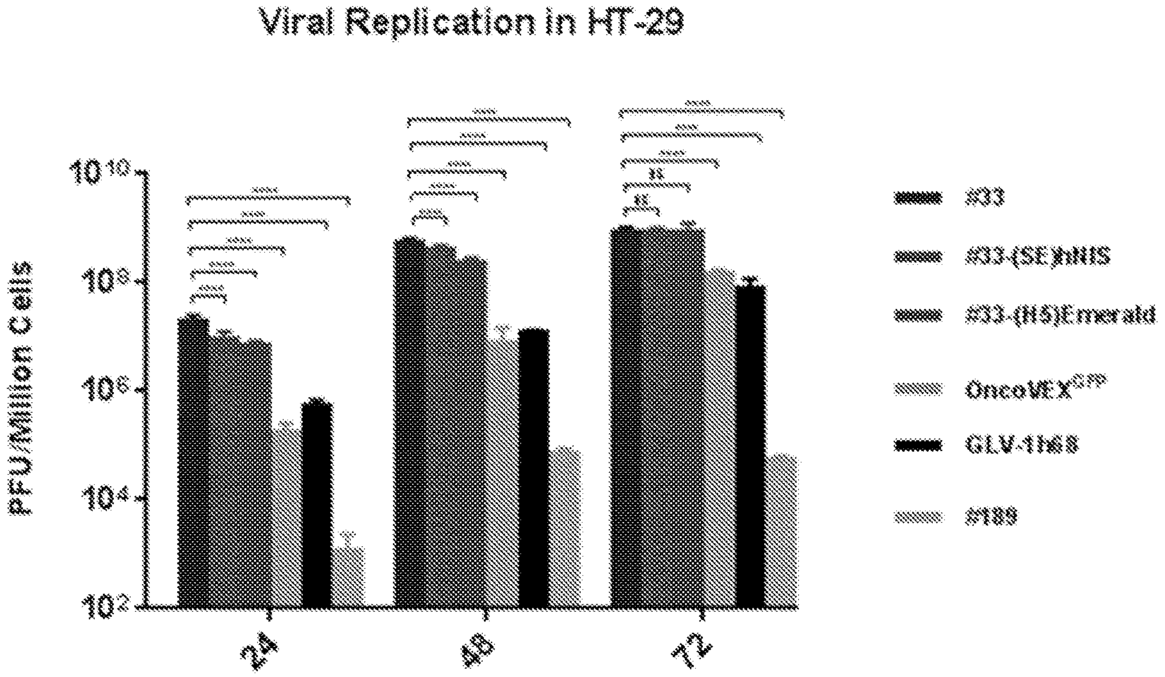
Figure 20C:
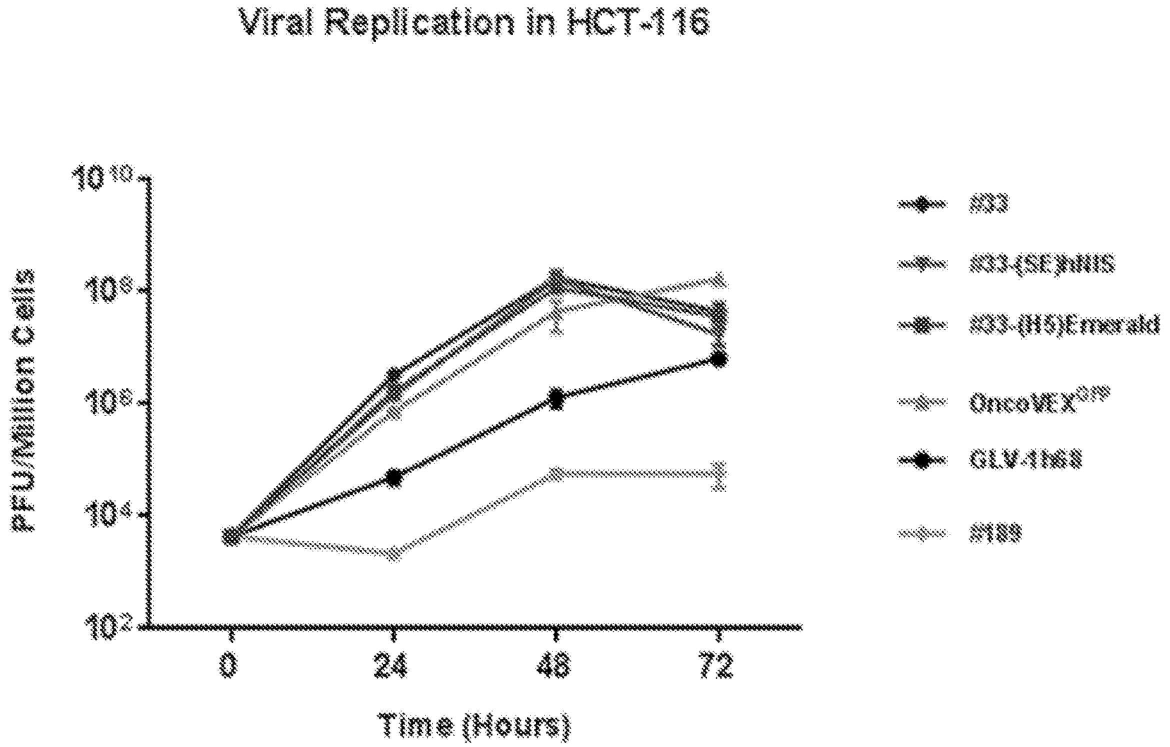
Figure 20D:
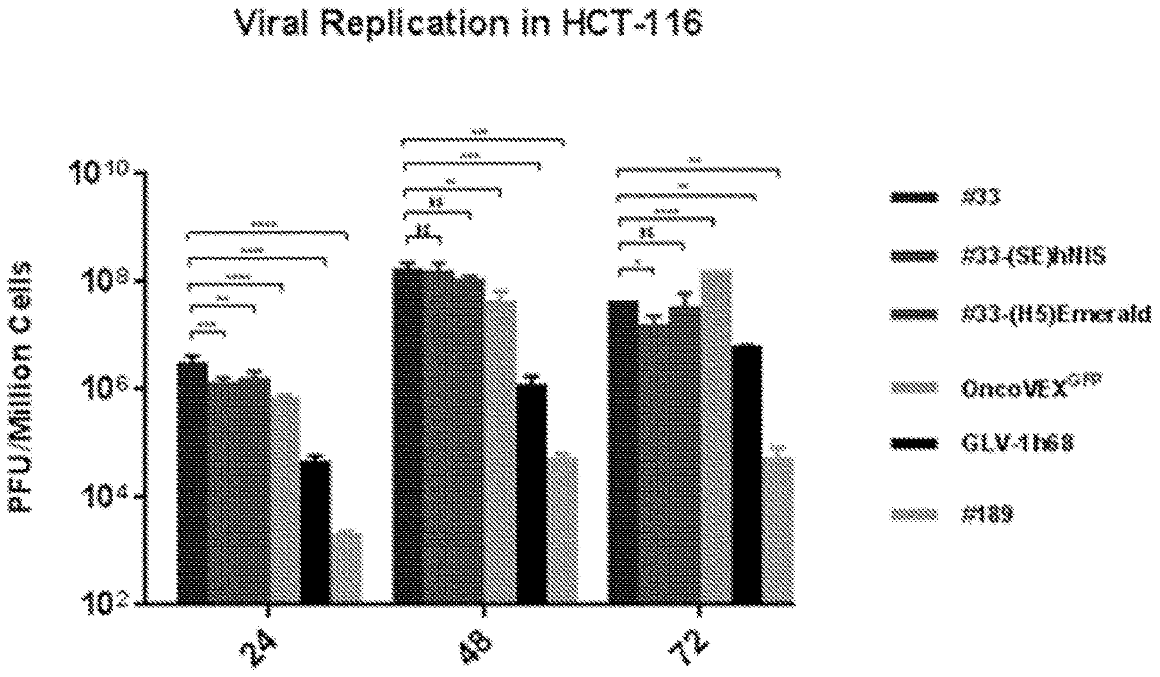

A viral replication curve was performed on HT-29 (FIGS. 20A-20B) and HCT-116 (FIGS. 20C-20D) cancer cell lines by plating cells at $5\times10^5$ cells per well in 2 mL McCoy's 5A media 10% FBS, 1% Antibiotic-Antimycotic solution for 24 hours in triplicate. Media was then aspirated and #33, #33-(SE)hNIS, #33-(H5)Emerald, OncoVEX$^{GFP}$, GLV-1h68, or #189 was added at a multiplicity of infection (MOI) 0.01 in 500 uL McCoy's 5A media 2.5% FBS, 1% Antibiotic-Antimycotic solution for 1 hour shaking every 20 minutes. At one hour, the media was aspirated and 1.5 mL of McCoy's 5A media 2.5% FBS, 1% Antibiotic-Antimycotic solution was added. At 24, 48, and 72 hours, cells and supernatant were collected and after three freeze and thaw cycles, serial dilutions were performed in duplicate. This experiment was repeated in duplicate. Statistical analysis was performed comparing #33 to other experimental groups using One-Way ANOVA at each time point.

Figure 21A:
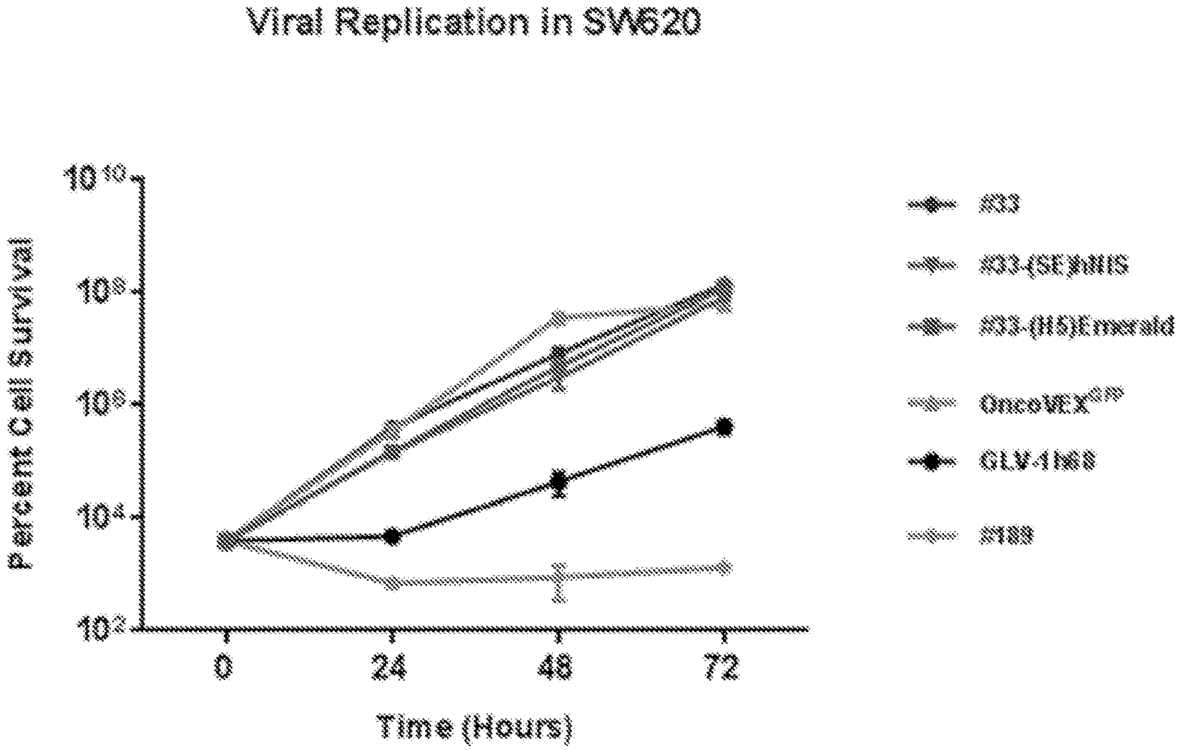
FIGS. 21A-21D. A viral replication curve was performed on SW620 and SW480 cancer cell lines by plating cells at $5\times10^5$ cells per well in 2 mL RPMI, 10% FBS, 1% Antibiotic-Antimycotic solution for 24 hours in triplicate. Media was then aspirated and #33, #33-(SE)hNIS, #33-(H5)Emerald, OncoVEX$^{GFP}$, GLV-1h68, or #189 was added at a multiplicity of infection (MOI) 0.01 in 500 μL RPMI 2.5% FBS, 1% Antibiotic-Antimycotic solution for 1 hour shaking every 20 minutes. At one hour, the media was aspirated and 1.5 mL of RPMI, 2.5% FBS, 1% Antibiotic-Antimycotic solution was added. At 24, 48, and 72 hours, cells and supernatant were collected and after three freeze and thaw cycles, serial dilutions were performed in duplicate. This experiment was repeated in duplicate. Presented are graphs showing PFU/Million cells over time for SW620 (FIG. 21A) and SW480 (FIG. 21C). Also presented are bar graphs comparing PFU/Million cells at each time point for each virus in SW620 (FIG. 21B) and SW480 (FIG. 21D) treated cancer cells. Statistical analysis was performed comparing #33 to other experimental groups using One-Way ANOVA at each time point.
Figure 21B:
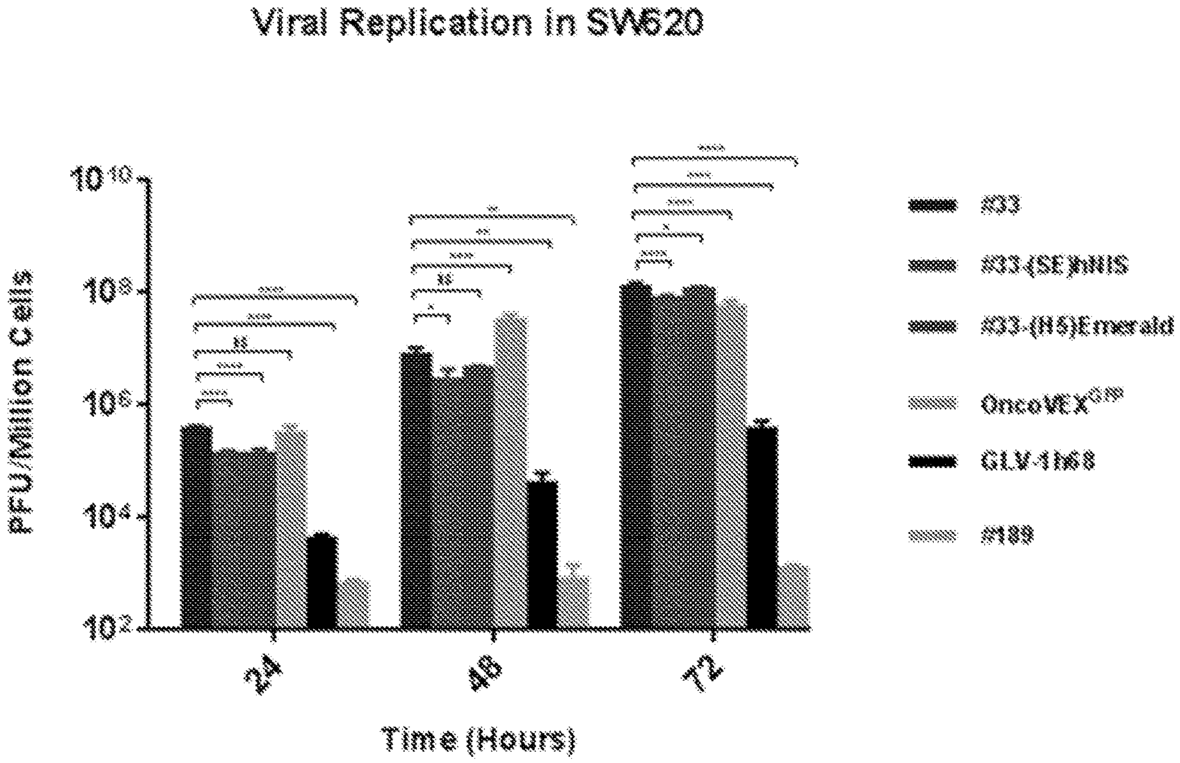
Figure 21C:
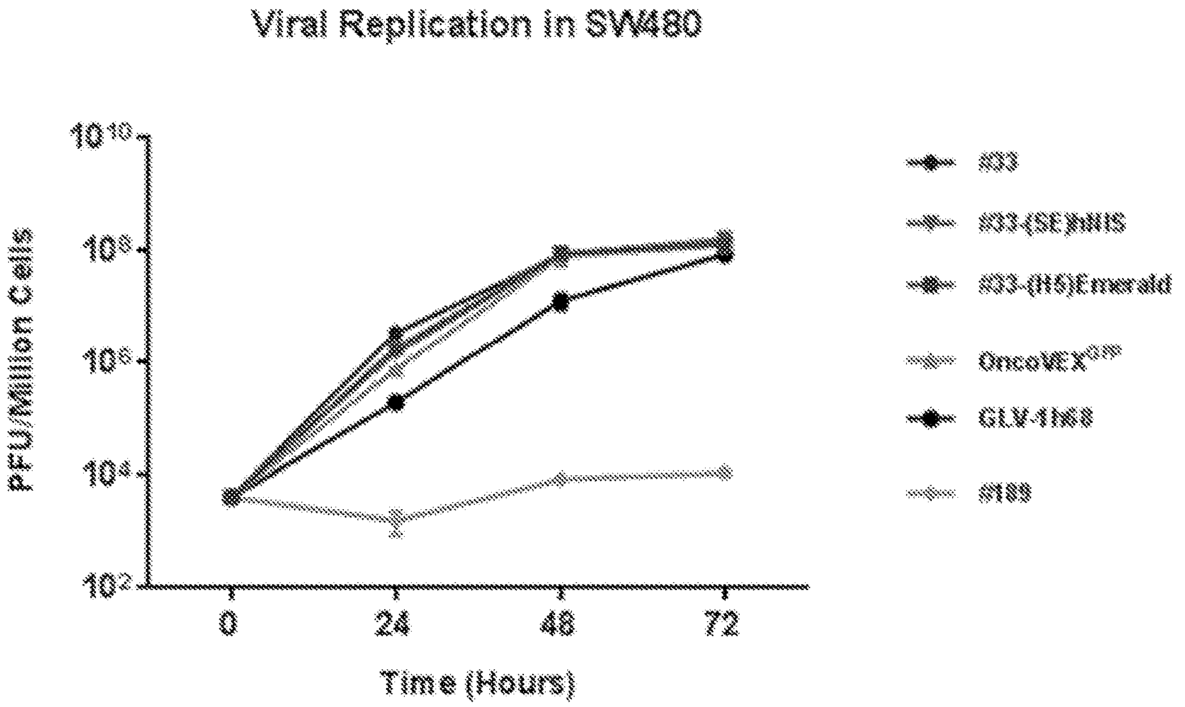
Figure 21D:
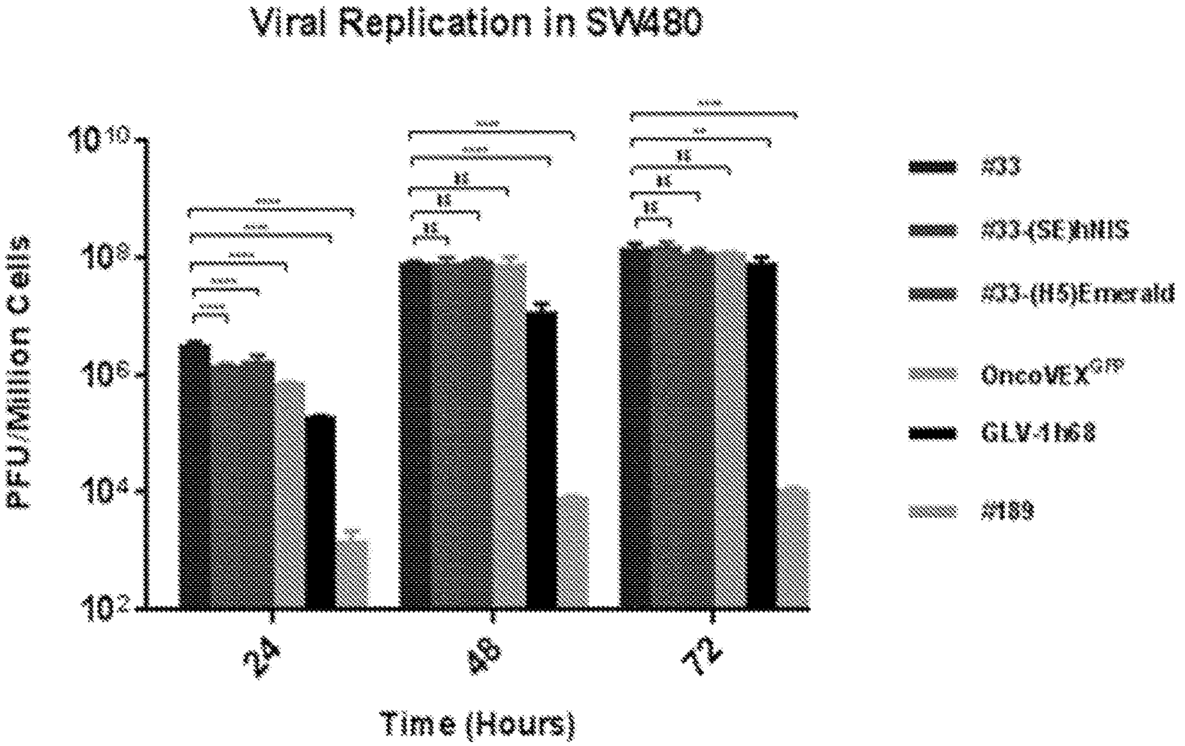

A viral replication curve was performed on SW620 (FIGS. 21A-21B) and SW480 (FIGS. 21C-21D) cancer cell lines by plating cells at $5\times10^5$ cells per well in 2 mL RPMI 10% FBS, 1% Antibiotic-Antimycotic solution for 24 hours in triplicate. Media was then aspirated and #33, #33-(SE)hNIS, #33-(H5)Emerald, OncoVEX$^{GFP}$, GLV-1h68, or #189 was added at a multiplicity of infection (MOI) 0.01 in 500 uL RPMI 2.5% FBS, 1% Antibiotic-Antimycotic solution for 1 hour shaking every 20 minutes. At one hour, the media was aspirated and 1.5 mL of RPMI 2.5% FBS, 1% Antibiotic-Antimycotic solution was added. At 24, 48, and 72 hours, cells and supernatant were collected and after three freeze and thaw cycles, serial dilutions were performed in duplicate. This experiment was repeated in duplicate. Statistical analysis was performed comparing #33 to other experimental groups using One-Way ANOVA at each time point.

HCT-116 #33-(SE)hNIS Immunohistochemistry

Figure 22:
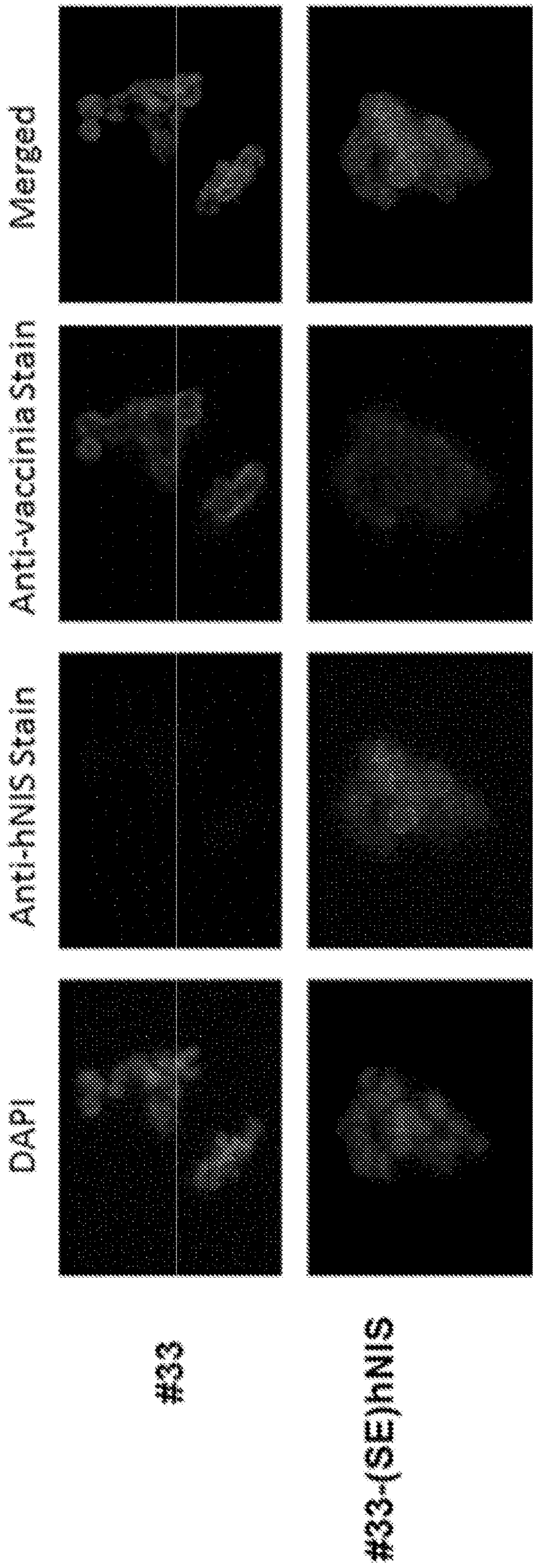
FIG. 22. Immunohistochemical analysis of HCT-116 cancer cells infected with virus #33 or #33-(SE)hNIS. Images taken 24 h post-infection with MOI of 0.01.

In vitro imaging of #33-(SE)hNIS was performed in HCT-116 at 24, 48, and 72 hours at MOIs of 1, 0.1, and 0.01. $2\times10^5$ HCT 116 cells were added to each well of an 8 chamber slide in 500 μL of 10% FBS McCoy's 5A media. The media was aspirated after 24 hours of incubation and the appropriate MOI of #33-(SE)hNIS was added to each well in 200 μL of 2.5% FBS McCoy's 5A media. After 1 hour, the media was aspirated and the cells were washed with PBS twice. The media was replaced with 1 mL 10% FBS McCoy's 5A media. After 24, 48 or 72 hours, the media was aspirated. Fixation was performed with 4% paraformaldehyde for 15 minutes at room temperature. This was then washed with PBS twice. Permeabilization was performed with 0.1% Triton X-100 in PBS for 5 minutes on ice. The cells were again washed with PBS. Slides were then incubated in TNB blocking buffer for 30 min at 37° C. (TNB blocking buffer: 0.1M Tris-HCl, PH7.5, 0.15 NaCl and 0.5% Blocking Reagent-Perkin Elmer, cat FP1020). A 1:50 dilution of mouse anti-human sodium iodine transporter (hNIS) antibody in TNB blocking buffer was added and incubated overnight at 4° C. (ab 17795). The slides were then washed with PBS twice and then a 1:100 dilution of goat anti-mouse IgG H&L (Alexa Fluor 488) (ab150113) in TNB blocking buffer was added and incubated at room temperature for 1 hour. Cells were then washed with PBS twice. A 1:200 dilution of rabbit anti-vaccinia (ab35219) in TNB was added and incubated overnight at 4° C. The cells were then washed with PBS twice. Blocking with TNB occurred for 30 minutes. Next, a 1:100 dilution of goat anti-rabbit secondary antibody was added and placed in room temperature for 1 hour. After two washes with PBS, 1:1000 dilution of DAPI was added at room temperature for 5 minutes. Again, PBS washing was performed. Images were taken using EVOS auto cell imaging system (FIG. 22).

HT-29 #33-(SE)hNIS Immunohistochemistry

Figure 23:
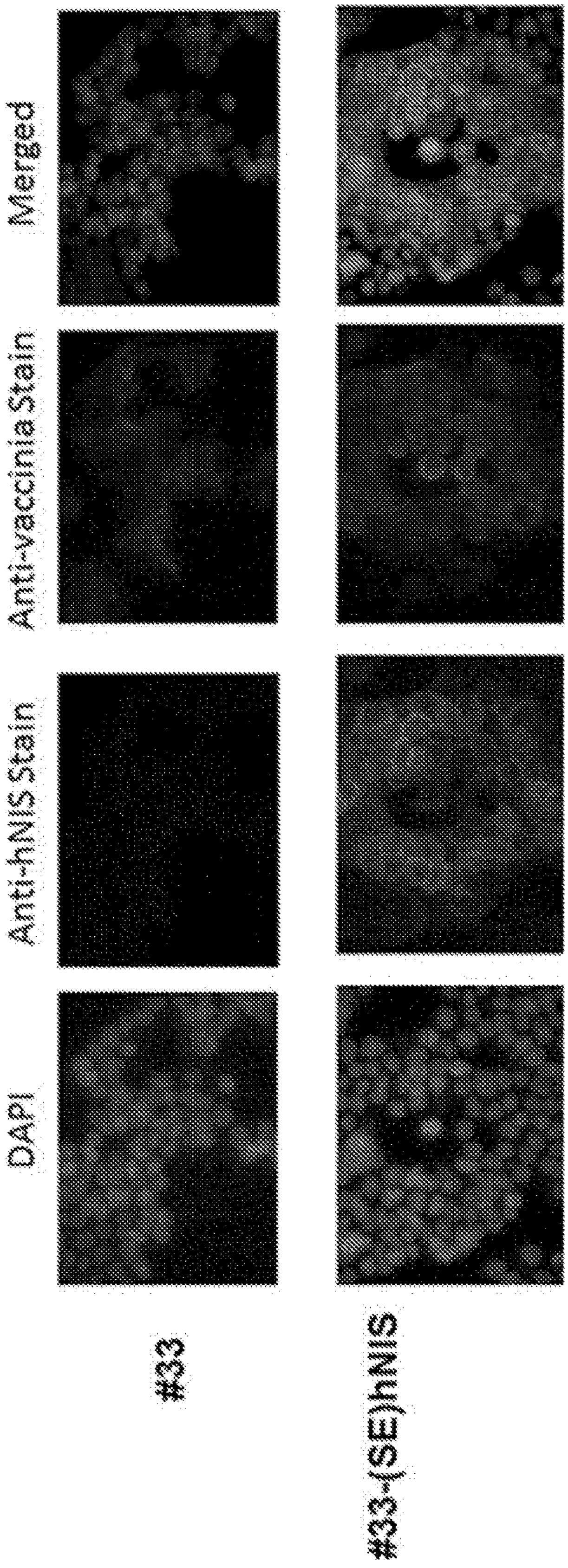
FIG. 23. Immunohistochemical analysis of HT-29 cancer cells infected with virus #33 or #33-(SE)hNIS. Images taken 24 h post-infection with MOI of 0.01.

In vitro imaging of #33-(SE)hNIS was performed in HT-29 at 24, 48, and 72 hours at MOIs of 1, 0.1, and 0.01. $2\times10^5$ HCT 116 cells were added to each well of an 8 chamber slide in 500 μL of 10% FBS McCoy's 5A media. The media was aspirated after 24 hours of incubation and the appropriate MOI of #33-(SE)hNIS was added to each well in 200 uL of 2.5% FBS McCoy's 5A media. After 1 hour, the media was aspirated and the cells were washed with PBS twice. The media was replaced with 1 mL 10% FBS McCoy's 5A media. After 24, 48 or 72 hours, the media was aspirated. Fixation was performed with 4% paraformaldehyde for 15 minutes at room temperature. This was then washed with PBS twice. Permeabilization was performed with 0.1% Triton X-100 in PBS for 5 minutes on ice. The cells were again washed with PBS. Slides were then incubated in TNB blocking buffer for 30 min at 37° C. (TNB blocking buffer: 0.1M Tris-HCl, PH7.5, 0.15 NaCl and 0.5% Blocking Reagent-Perkin Elmer, cat FP1020). A 1:50 dilution of mouse anti-human sodium iodine transporter (hNIS) antibody in TNB blocking buffer was added and incubated overnight at 4° C. (ab 17795). The slides were then washed with PBS twice and then a 1:100 dilution of goat anti-mouse IgG H&L (Alexa Fluor 488) (ab150113) in TNB blocking buffer was added and incubated at room temperature for 1 hour. Cells were then washed with PBS twice. A 1:200 dilution of rabbit anti-vaccinia (ab35219) in TNB was added and incubated overnight at 4° C. The cells were then washed with PBS twice. Blocking with TNB occurred for 30 minutes. Next, a 1:100 dilution of goat anti-rabbit secondary antibody was added and placed in room temperature for 1 hour. After two washes with PBS, 1:1000 dilution of DAPI was added at room temperature for 5 minutes. Again, PBS washing was performed. Images were taken using EVOS auto cell imaging system (FIG. 23).

Treatment of Colon Cancer Tumors In Vivo

Figure 24:
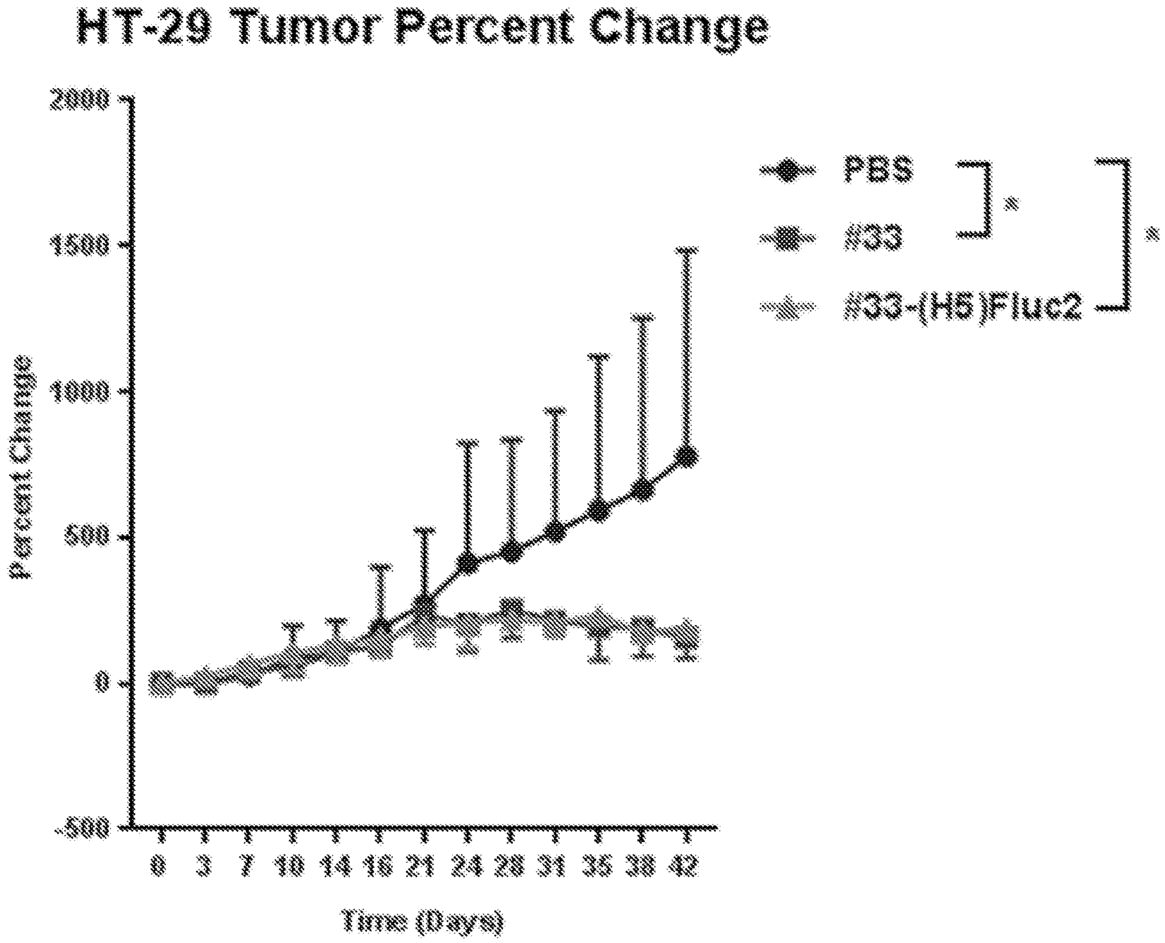
FIG. 24. Fourteen athymic Nude-Foxn1$^{nu}$ female nude mice (Envigo, Indianapolis, IN) were implanted with $5\times10^6$ cells per bilateral flank tumors of HT-29. Once tumor dimensions reached approximately 200 $mm^3$, both tumors were injected with 504, of PBS (4 mice), #33 (5 mice), or #33-(H5)Fluc2 (5 mice) at approximately 1×10^5 PFU/dose. Net percent weight change and percent change of tumors were recorded twice weekly for 42 days.

Fourteen athymic Nude-Foxn1$^{nu}$ female nude mice (Envigo, Indianapolis, IN) were implanted with $5\times10^6$ cells per bilateral flank tumors of HT-29. Once tumor dimensions reached approximately 200 $mm^3$, both tumors were injected with 50 μL of PBS (4 mice), #33 (5 mice), or #33-(H5)Fluc2 (5 mice) at approximately $1\times10^5$ PFU/dose. Net percent weight change and percent change of tumors were recorded twice weekly for 42 days. Two mice from each group were sacrificed after 10 days and viral titration and IHC was performed on the organs. All remaining mice were sacrificed at 42 days and viral titration was performed on the mice organs. A significant difference in tumor volume percent change (FIG. 24) was noted when comparing PBS control to both #33 (3 mice) and #33-(H5)Fluc2 (p=0.02 and p=0.03, respectively).

Figure 25:
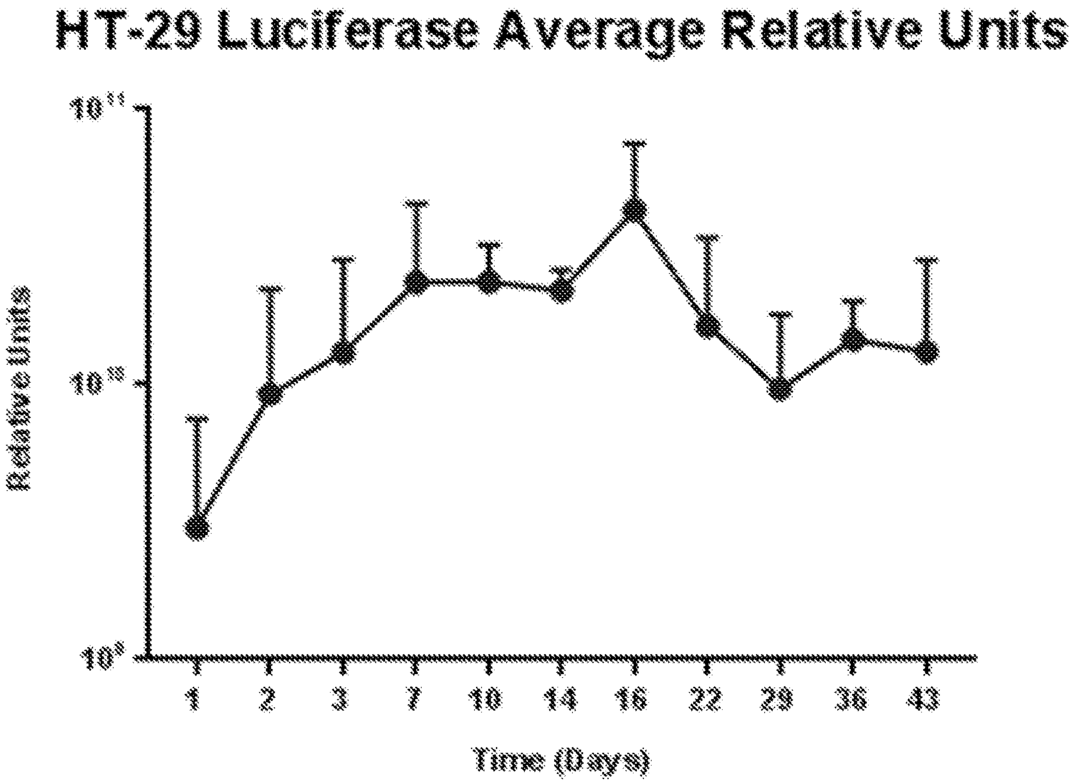
FIG. 25. Twice per week, one PBS control mouse and 3 #33-(H5)Fluc2 injected mice were injected with 4.28 mg luciferin in 1500 μL of PBS intraperitoneally. After 7 minutes, luciferase imaging was obtained at a standard exposure. The relative unit was recorded at each time point and analyzed relative to the PBS control mice as a background.

Twice per week, one PBS control mouse and 3 #33-(H5) Fluc2 injected mice were injected with 4.28 mg luciferin in 150 uL of PBS intraperitoneally. After 7 minutes, luciferase imaging was obtained at a standard exposure. The relative unit was recorded at each time point and analyzed relative to the PBS control mice as a background (FIG. 25).

Figure 26:
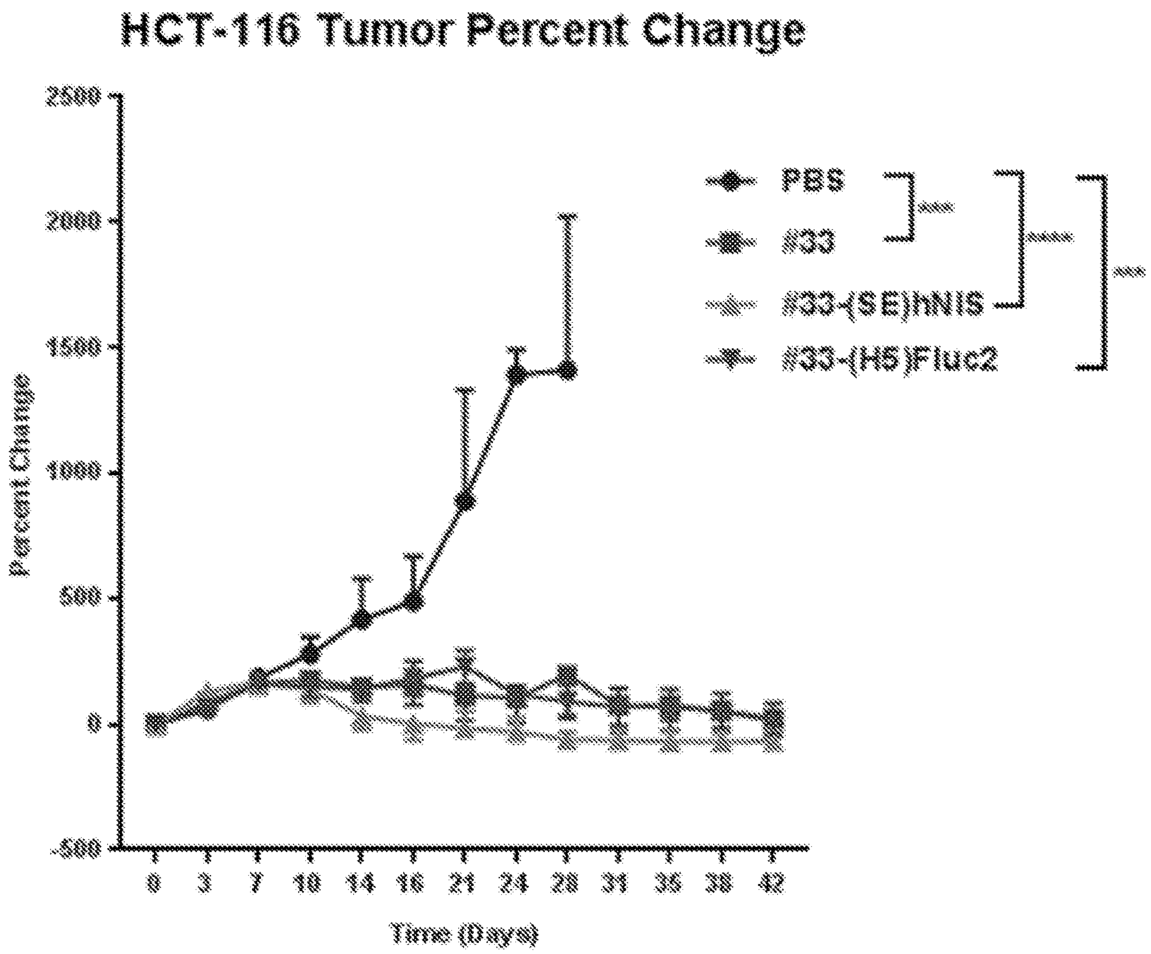
FIG. 26. Nineteen athymic Nude-Foxn1$^{nu}$ female nude mice (Envigo, Indianapolis, IN) were implanted with $5\times10^6$ bilateral flank tumors of HCT-116. Once tumor dimensions reached approximately 200 $mm^3$, both tumors were injected with 50 μL of PBS (2 mice), #33 (3 mice), #33-(SE)hNIS or #33-(H5)Fluc2 at approximately $1\times10^5$ PFU/dose. Net percent weight change and percent change of the tumors were recorded twice weekly for 42 days.

Nineteen athymic Nude-Foxn1$^{nu}$ female nude mice (Envigo, Indianapolis, IN) were implanted with $5\times10^6$ bilateral flank tumors of HCT-116. Once tumor dimensions reached approximately 200 $mm^3$, both tumors were injected with 50 μL of PBS (2 mice), #33 (3 mice), #33-(SE)hNIS or #33-(H5)Fluc2 at approximately 1×10^5 PFU/dose. Net percent weight change and percent change of the tumors were recorded twice weekly for 42 days. 2 mice per group were sacrificed after 10 days and viral titration and IHC was performed on the organs. All remaining mice were sacrificed at 42 days and viral titration was performed on the mice organs. A significant difference in tumor volume percent change was noted when comparing PBS control to #33 (3 mice), #33-(SE)hNIS and #33-(H5)Fluc2 (FIGS. 26; p=0.0002, p=0.0001 and p=0.0002, respectively).

Figure 27:
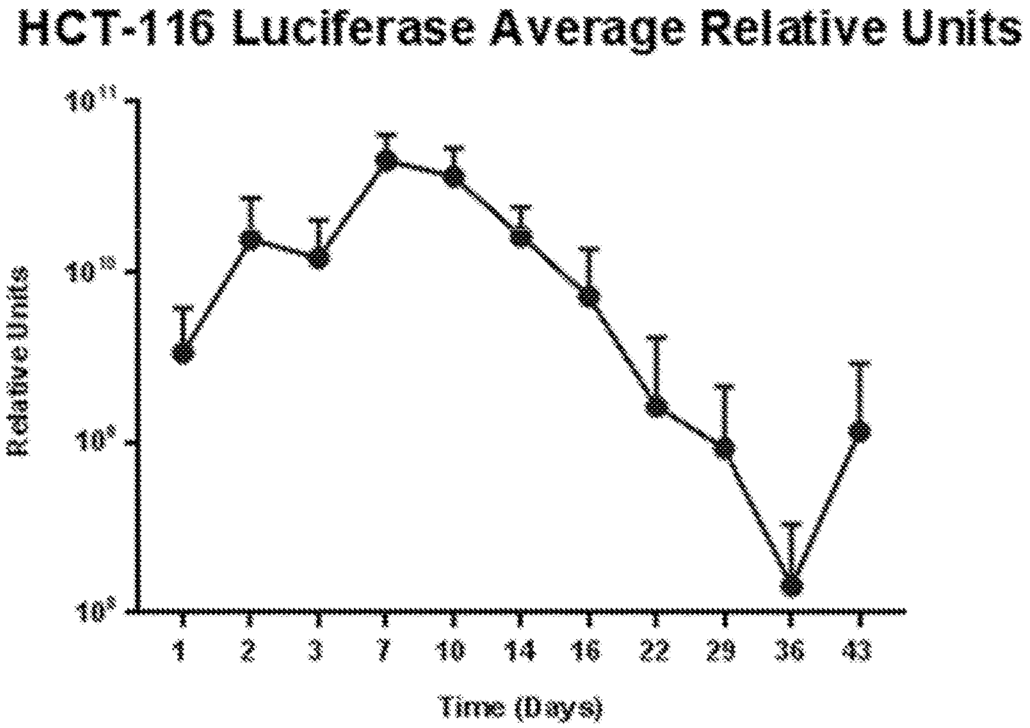
FIG. 27. Twice per week, one PBS control mouse and 3 #33-(H5)Fluc2 injected mice were injected with 4.28 mg luciferin in 150 μL of PBS intraperitoneally. After 7 minutes, luciferase imaging was obtained at a standard exposure. The relative unit was recorded at each time point and analyzed relative to the PBS control mice as a background.

Twice per week, one PBS control mouse and 3 #33-(H5) Fluc2 injected mice were injected with 4.28 mg luciferin in 150 uL of PBS intraperitoneally. After 7 minutes, luciferase imaging was obtained at a standard exposure. The relative unit was recorded at each time point and analyzed relative to the PBS control mice as a background (FIG. 27).

Example 9. Targeting Lung Cancer with Oncolytic Virotherapy

Cytotoxic Assay

Figure 28A:
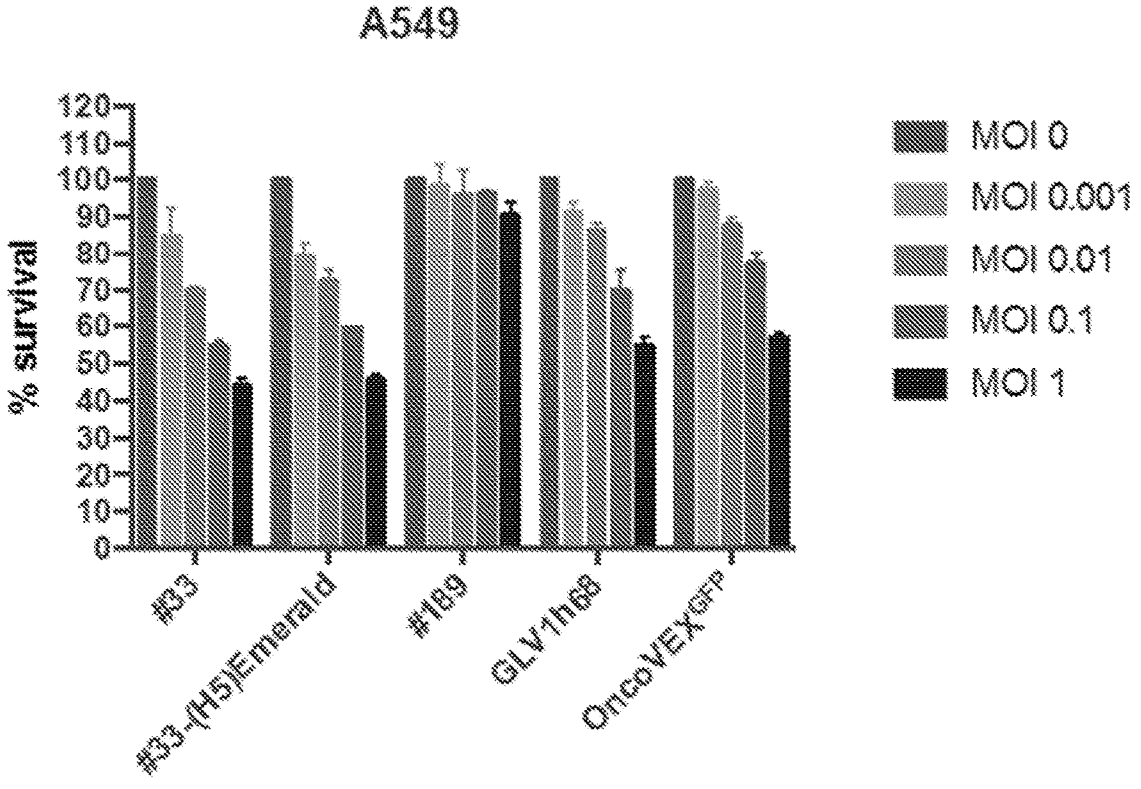
FIGS. 28A-28C. Oncolytic virus-mediated Cytoxicities in lung cancer and lung fibroblast cells, 72 h post-infection. 5000 cells of A549, H2199, or HF1 fibroblasts were plated in each well of a 96-well plate. The next day, cells were infected with different viruses (#33, #33-(H5)Emerald, #189, GLV-1h68, OncoVEX$^{GFP}$) at the indicated multiplicity of infection (MOI; 0, 0.001, 0.01, 0.1, 1 MOI) or were mock-infected. Cell viability was determined using CELL-TITER 96™ AQueous One Solution (Promega; Cat #G3581), 72 hours post-infection. Survival of infected A549 cells (FIG. 28A), H2199 cells (FIG. 28B), or HF1 fibroblasts (FIG. 28C) was calculated relative to that of mock-infected cells.
Figure 28B:
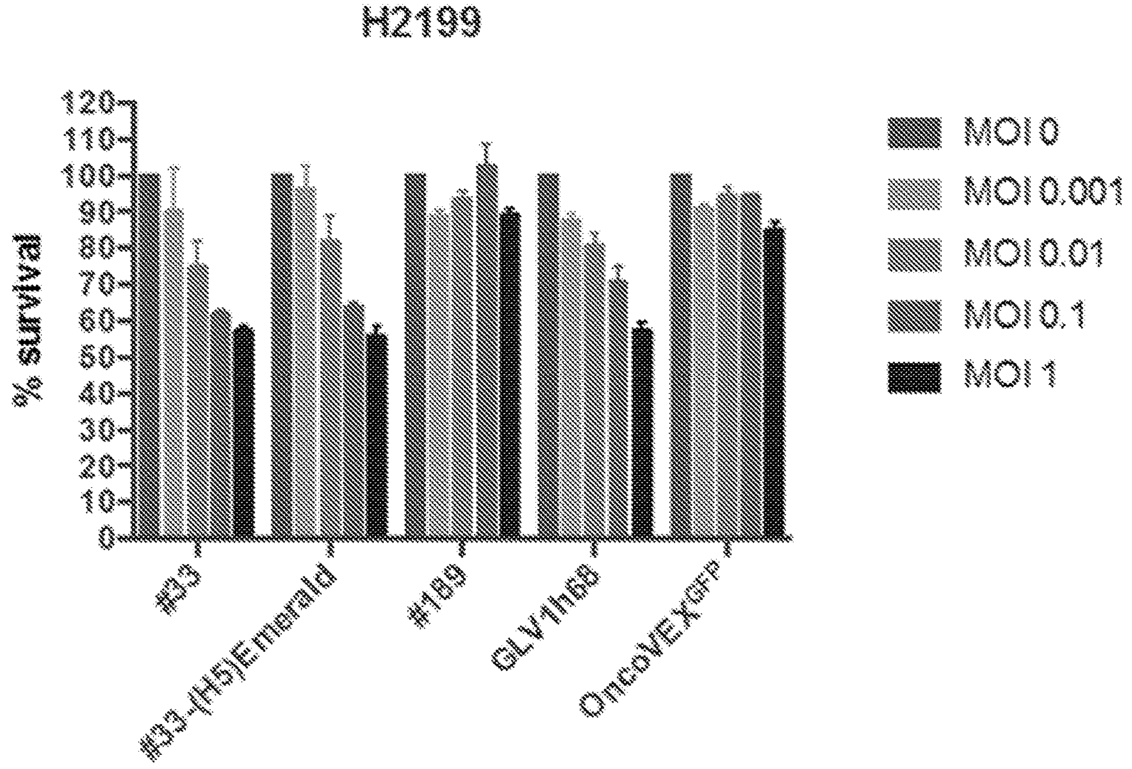
Figure 28C:
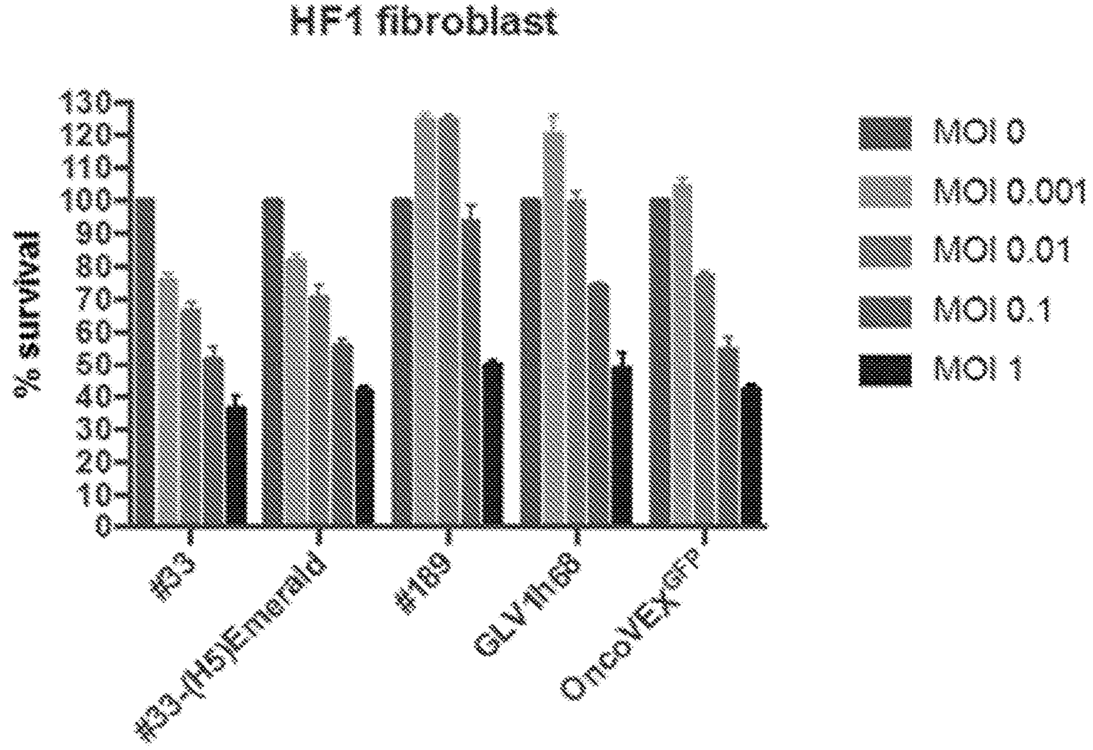

Oncolytic virus-mediated cytotoxicities in lung cancer and lung fibroblast cells, 72 h post-infection. 5000 cells of A549, H2199, or HF1 fibroblasts were plated in each well of a 96-well plate. The next day, cells were infected with different viruses at the indicated multiplicity of infection (MOI; 0, 0.001, 0.01, 0.1, 1 MOI) or were mock-infected. The viruses used were #33, #33-(H5)Emerald, #189, GLV-1h68, and OncoVEX$^{GFP}$. Cell viability was determined using CELLTITER 96™ AQueous One Solution (Promega; Cat #G3581), 72 hours post-infection. Survival of infected cells A549 (FIG. 28A), H2199 (FIG. 28B) and HF1 fibroblasts (FIG. 28C) was calculated relative to that of mock-infected cells.

Treatment of Lung Cancer Tumors In Vivo

Figure 29:
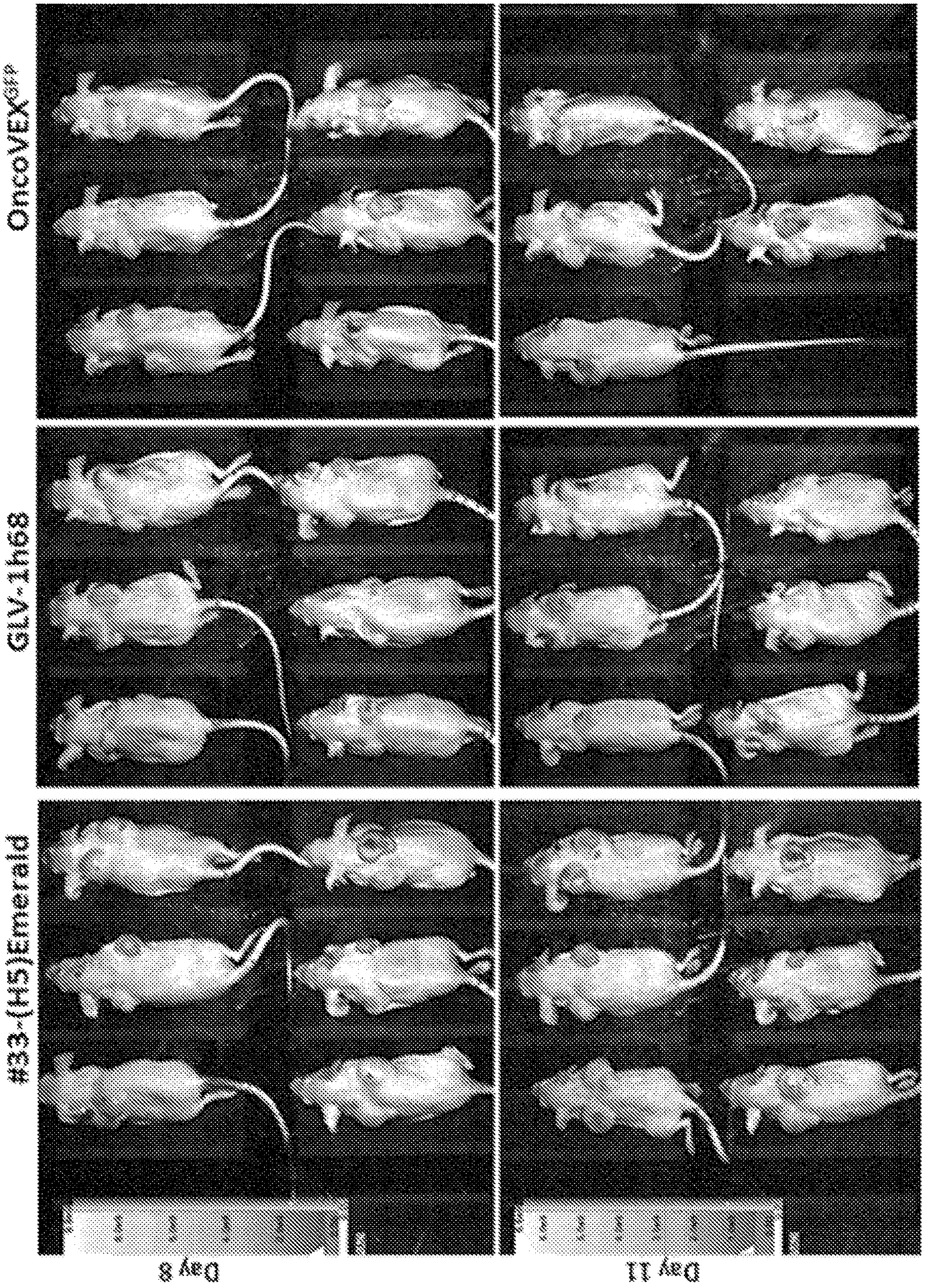
FIG. 29. GFP-images across days in A549 xenograft model after single injection of 1000 PFUs of virus (#33-(H5)Emerald, GLV-1h68, or OncoVEX$^{GFP}$ intra-tumorally) as indicated in the right tumor.
Figure 29:
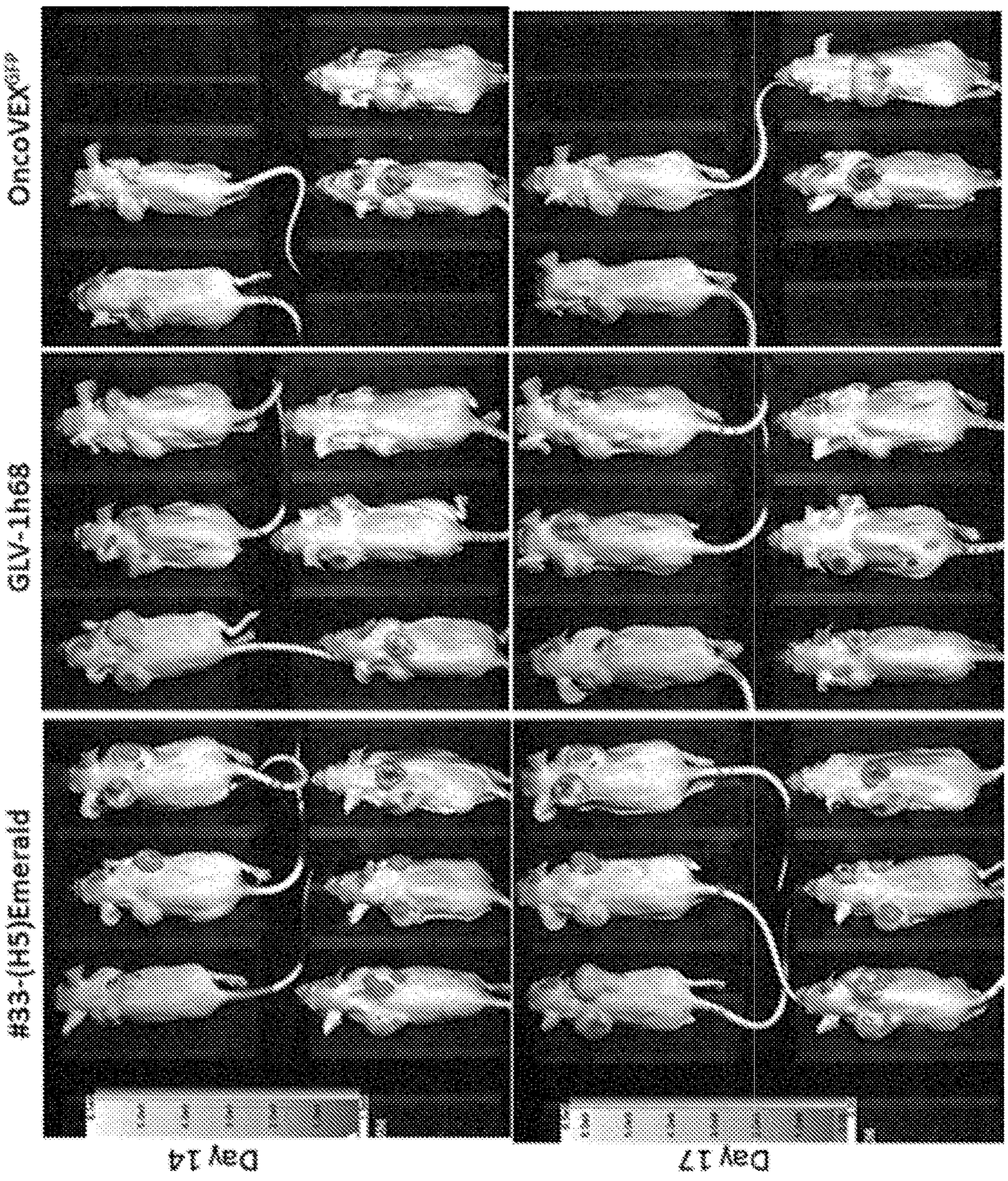

A549, human lung cancer cells, were cultured, trysinized, washed with PBS and resuspended in 1:1 PBS and matrigel to get $5\times10^6$ cells per 100 μL. 100 μL of the cell suspension was injected subcutaneously on each side of upper flank of athymic nude mice to generate 2 tumors per mouse. 3 weeks post-tumor cell injections, the mice were sorted into different treatment groups (n=3) so as to obtain similar average tumor volume in each group (~200 $mm^3$). After sorting, only the right-side tumor in each mouse was injected with $10^3$ plaque forming units (PFUs) of #33-(H5)Emerald, GLV1h68 or OncoVEX$^{GFP}$ intra-tumorally. All 3 viruses encode a gene for green fluorescent protein (GFP). Mice were imaged for green fluorescence (excitation: 465 & emission: 530 nm) twice weekly using small animal imaging equipment (LagoX imaging system) and images were processed on the AMIview image processing software (FIG. 29).

Figure 30:
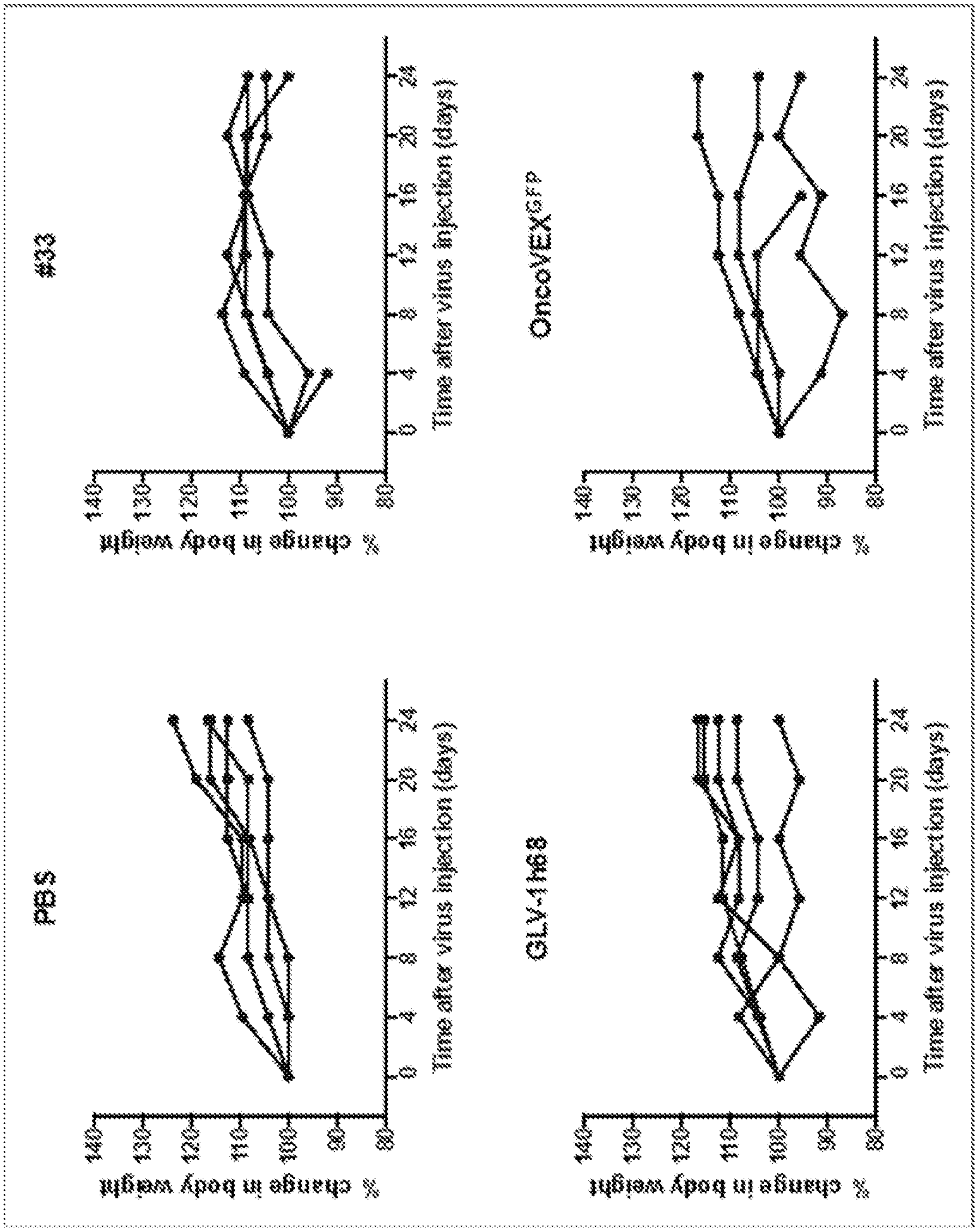
FIG. 30. Weight of mice across days in an A549 xenograph model. 3 weeks post-tumor cell A549 injections, the mice were sorted into different treatment groups (n=4 or 5) so as to obtain similar average tumor volume in each group (~200 $mm^3$) and the right-side tumor in each mouse was injected with $10^3$ PFUs of the indicated viruses (#33, #33-(H5)Emerald, GLV-1h68, OncoVEX$^{GFP}$, T-VEC, #189, PBS control) intra-tumorally or #33-(H5)Emerald injected intraperitoneally (i.p,). Mice were weighed twice weekly and the percent change in their weight is shown. Each line represents the weight of an individual mouse.
Figure 30:
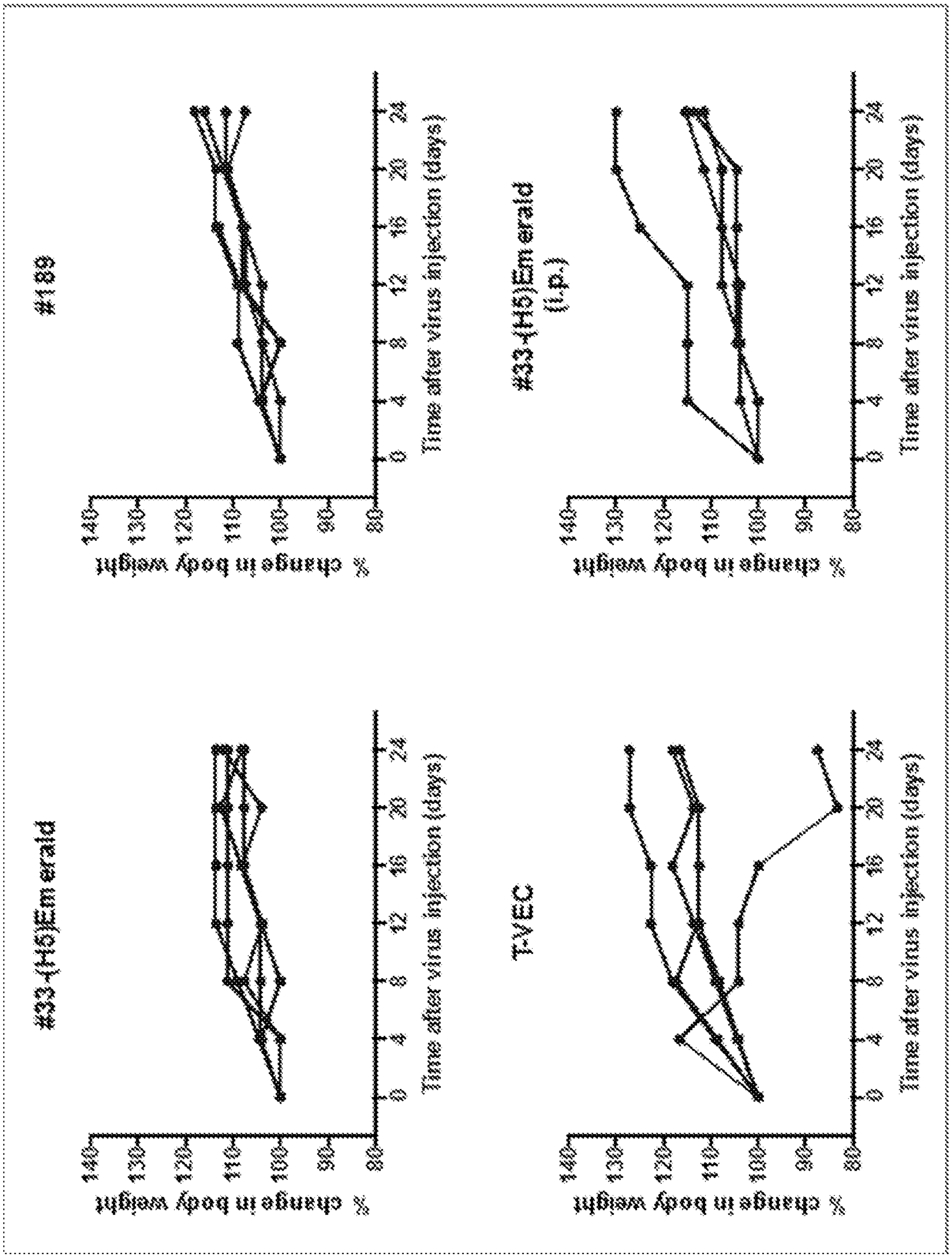

Mouse weight. A549, human lung cancer cells, were cultured, trysinized, washed with PBS and resuspended in 1:1 PBS and matrigel to get $5\times10^6$ cells per 100 μL. 100 μL of the cell suspension was injected subcutaneously on each side of upper flank of athymic nude mice to generate 2 tumors per mouse. 3 weeks post-tumor cell injections, the mice were sorted into different treatment groups (n=4 or 5) so as to obtain similar average tumor volume in each group (~200 $mm^3$). After sorting, only the right-side tumor in each mouse was injected with $10^3$ PFUs of the indicated viruses (#33, #33-(H5)Emerald, GLV-1h68, OncoVEX$^{GFP}$, T-VEC, #189, PBS control) intra-tumorally or #33-(H5)Emerald injected intraperitoneally (i.p,). Mice were weighed twice weekly and percent change in their weight was determined (FIG. 30). In FIG. 30, each line represents weight of an individual mouse.

Figure 31A:
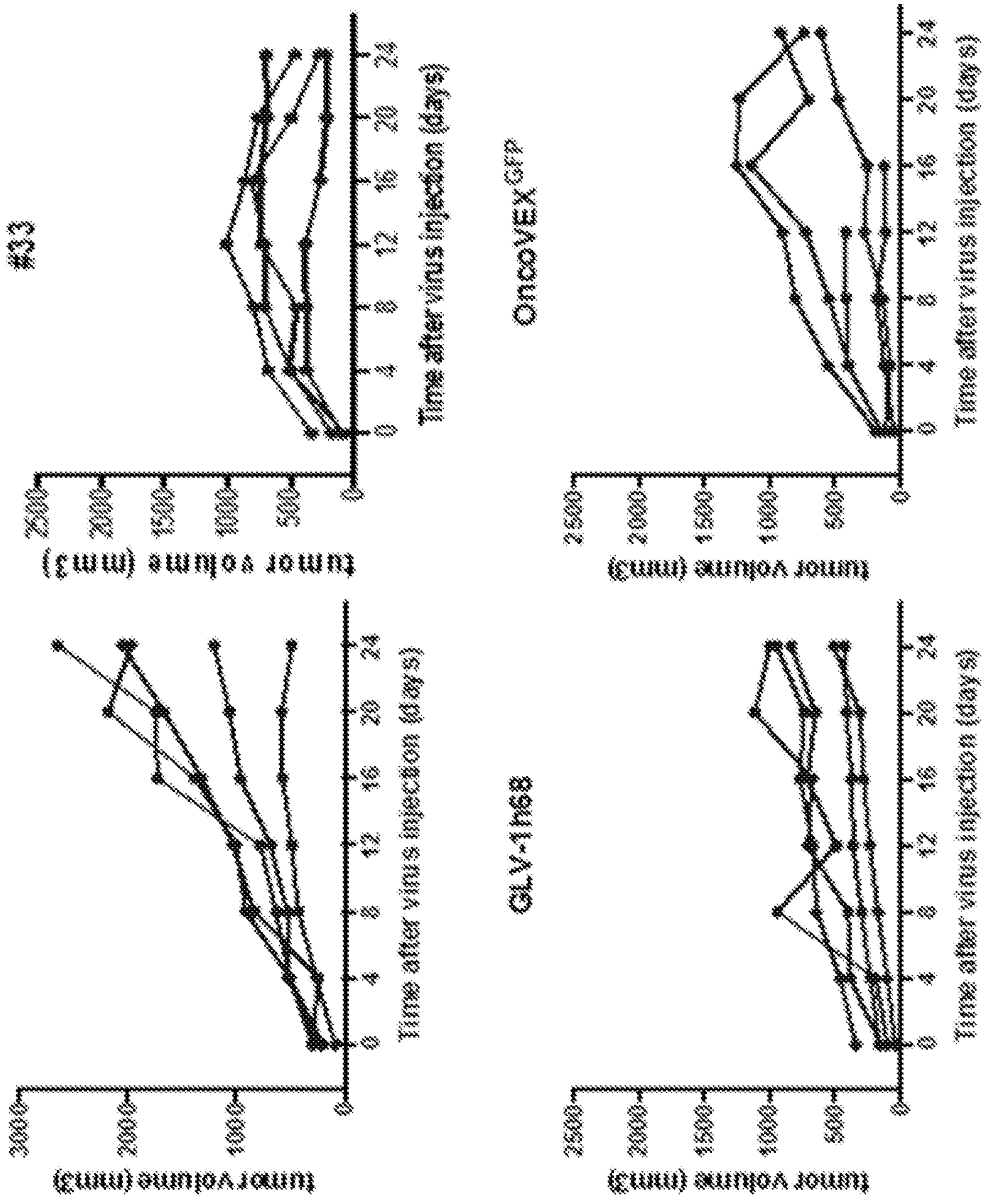
FIG. 31A-31B. Tumor regression in an A549 xenograph model. 3 weeks post-tumor cell A549 injections, the mice were sorted into different treatment groups (n=4 or 5) so as to obtain similar average tumor volume in each group (~200 $mm^3$) and the right-side tumor in each mouse was injected with $10^3$ PFUs of the indicated viruses (#33, #33-(H5) Emerald, GLV-1h68, OncoVEX$^{GFP}$, T-VEC, #189, PBS control) intra-tumorally or #33-(H5)Emerald injected intraperitoneally (i.p,). Tumor volume of the injected (FIG. 31A) and un-injected (FIG. 31B) were measured twice weekly using digital calipers. Each line represents tumor volume for an individual mouse.
Figure 31A:
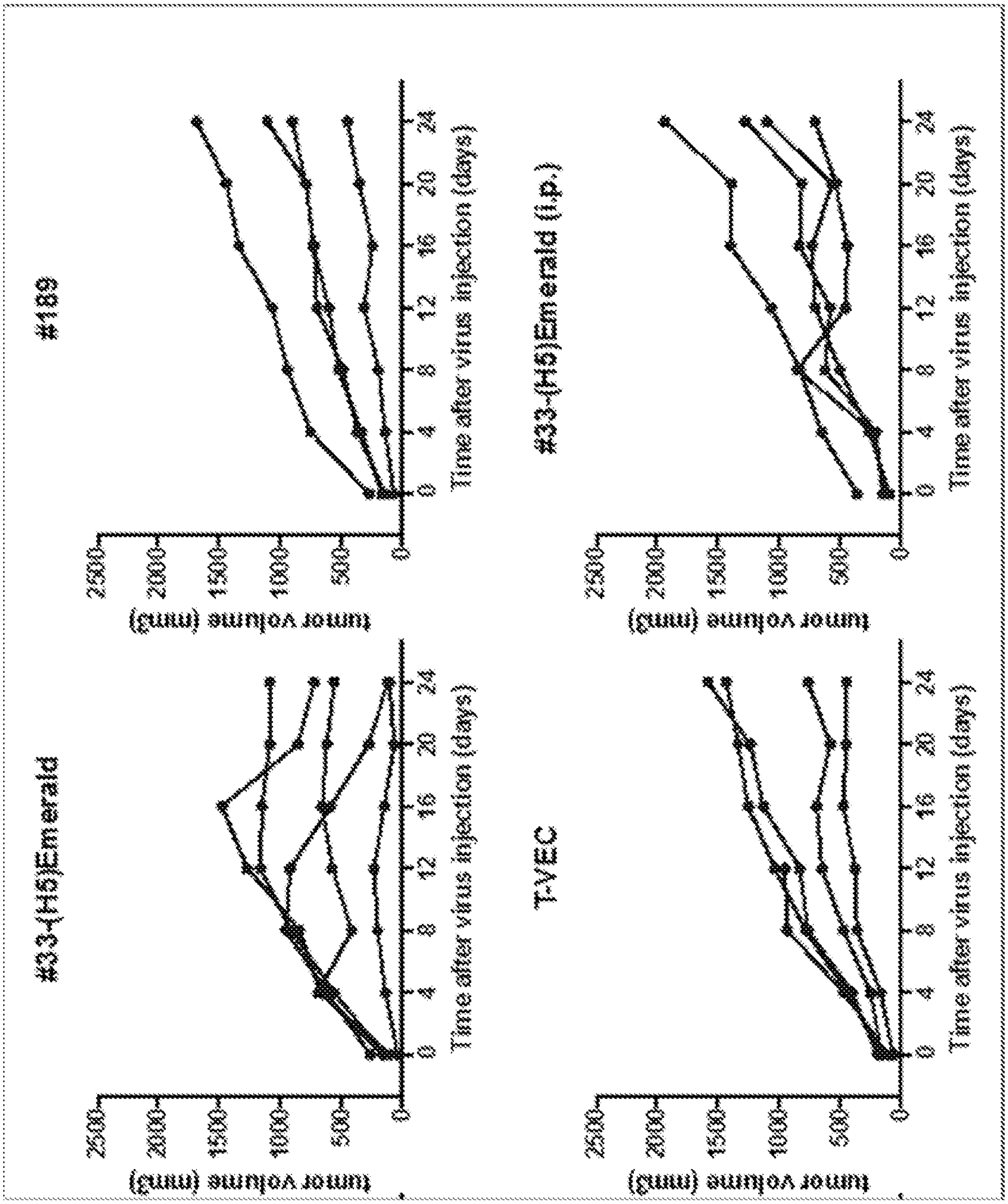
Figure 31B:
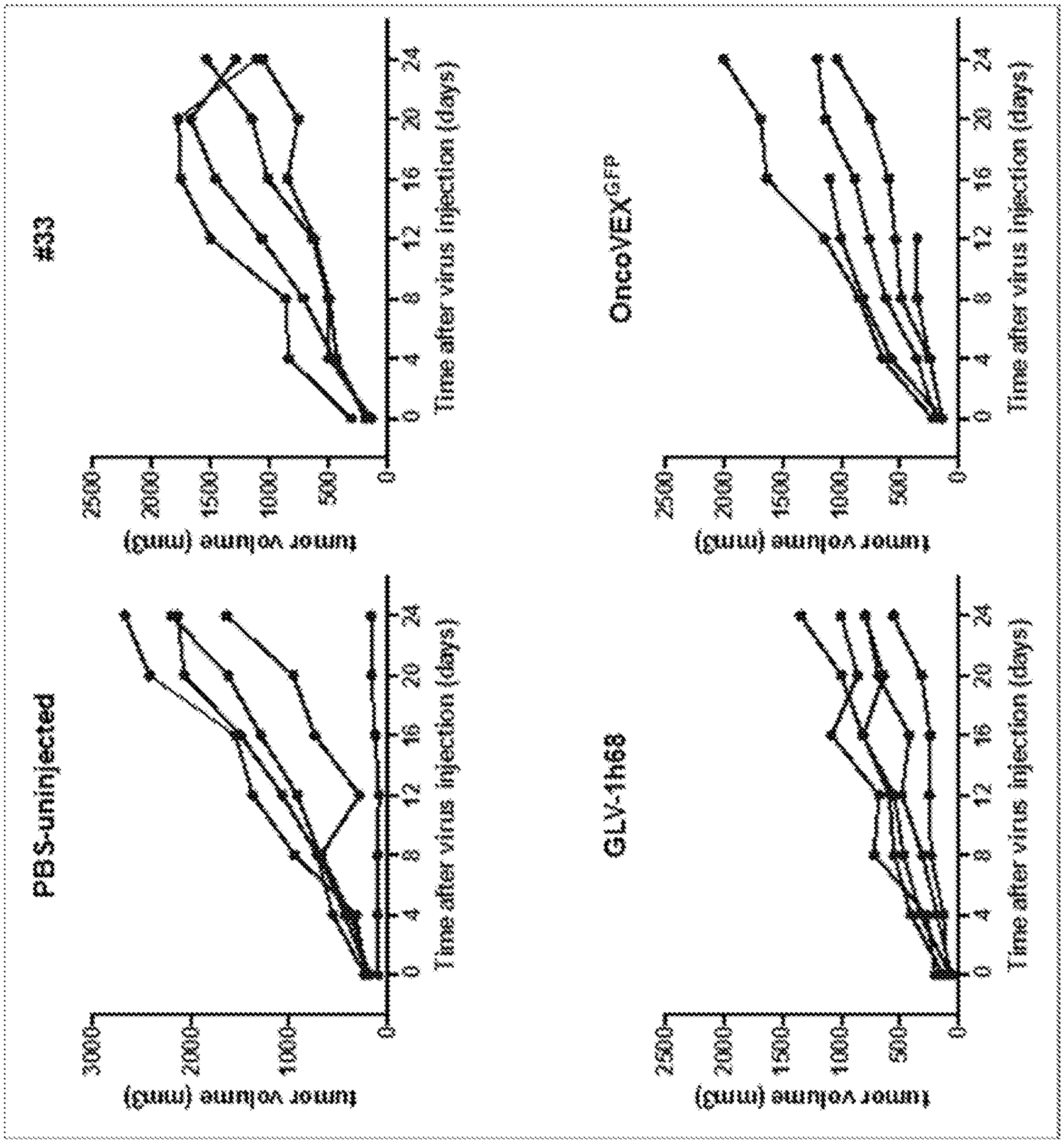
Figure 31B:
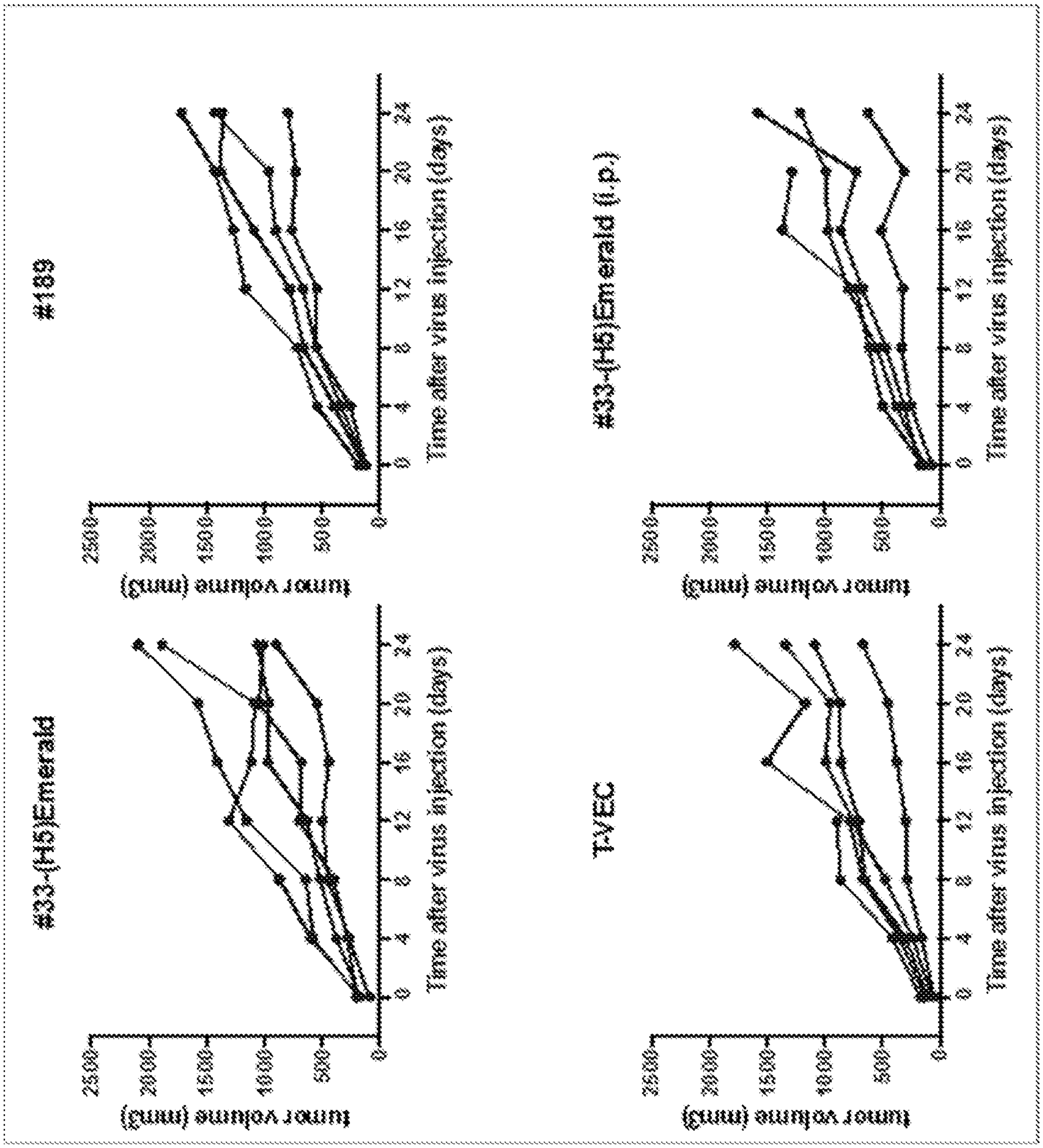

Tumor regression. A549, human lung cancer cells, were cultured, trysinized, washed with PBS and resuspended in 1:1 PBS and matrigel to get $5\times10^6$ cells per 100 μL. 100 μL of the cell suspension was injected subcutaneously on each side of upper flank of athymic nude mice to generate 2 tumors per mouse. 3 weeks post-tumor cell injections, the mice were sorted into different treatment groups (n=4 or 5) so as to obtain similar average tumor volume in each group (~200 $mm^3$). After sorting, only the right-side tumor in each mouse was injected with $10^3$ PFUs of the indicated viruses (#33, #33-(H5)Emerald, GLV-1h68, OncoVEX$^{GFP}$, T-VEC, #189, PBS control) intra-tumorally or #33-(H5)Emerald injected intraperitoneally (i.p.). Tumor volume for both injected (FIG. 31A) and un-injected (FIG. 31B) was measured twice weekly using digital calipers (volume={(length)$^2$× breadth/2}. In FIGS. 31A and 31B, each line represents tumor volume for individual mice.

Figure 32:
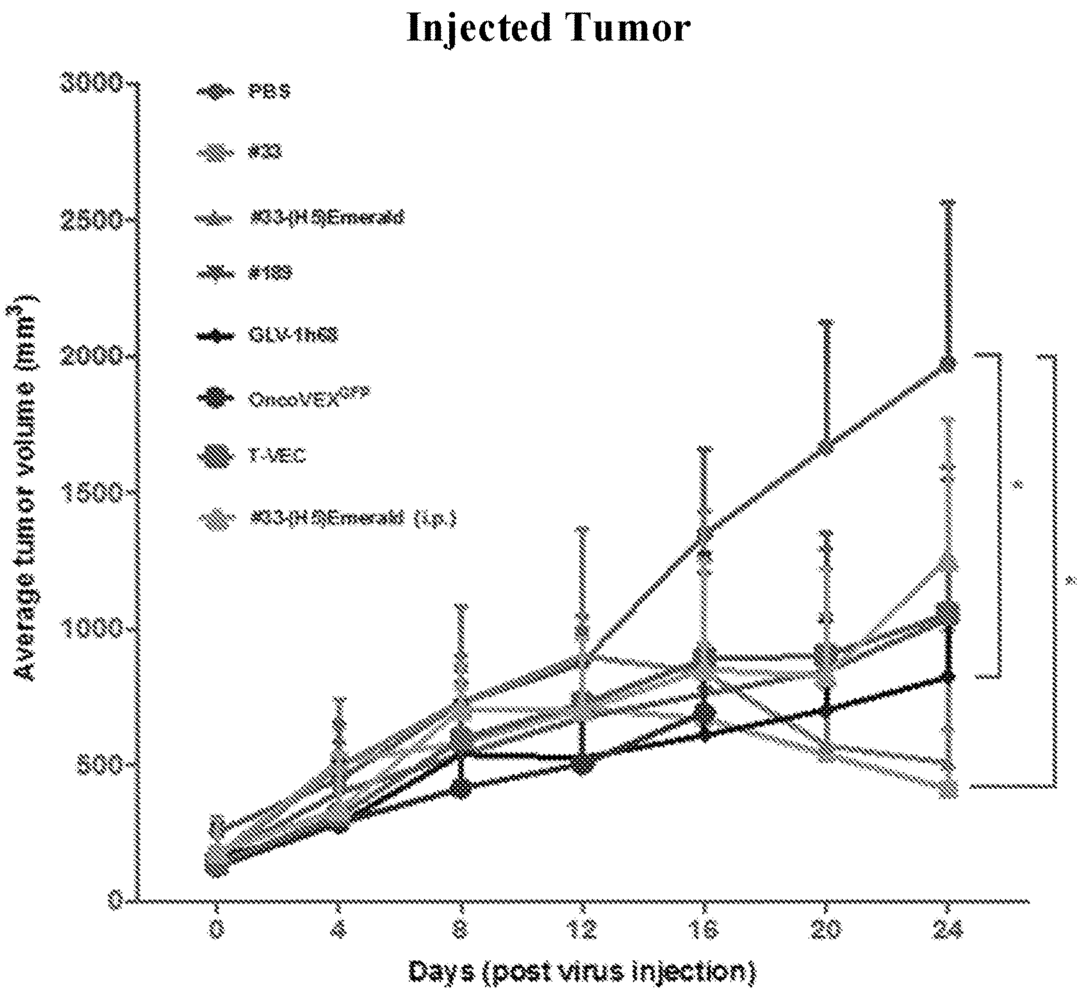
FIG. 32. Volume of virus-injected tumors in A549 xenograft model. 3 weeks post-tumor cell A549 injections, the mice were sorted into different treatment groups (n=4 or 5) so as to obtain similar average tumor volume in each group (~200 $mm^3$) and the right-side tumor in each mouse was injected with $10^3$ PFUs of the indicated viruses (#33, #33-(H5)Emerald, GLV-1h68, OncoVEX$^{GFP}$, T-VEC, #189, PBS control) intra-tumorally or #33-(H5)Emerald injected intraperitoneally (i.p,). Tumor volumes were measured twice weekly using digital calipers. Each line represents the average volume of injected tumors in individual treatment groups with the standard deviation. Statistical analysis: one-way ANOVA at day 24 (*=p<0.05).

Volume of virus-injected tumors in A549 xenograft model. A549, human lung cancer cells, were cultured, trysinized, washed with PBS and resuspended in 1:1 PBS and matrigel to get $5\times10^6$ cells per 100 μL. 100 μL of the cell suspension was injected subcutaneously on each side of upper flank of athymic nude mice to generate 2 tumors per mouse. 3 weeks post-tumor cell injections, the mice were sorted into different treatment groups (n=4 or 5) so as to obtain similar average tumor volume in each group (~200 $mm^3$). After sorting, only the right-side tumor in each mouse was injected with $10^3$ PFUs of the indicated viruses (#33, #33-(H5)Emerald, GLV-1h68, OncoVEX$^{GFP}$, T-VEC, #189, PBS control) intra-tumorally, or #33-(H5)Emerald injected intraperitoneally (i.p). Tumor volume was measured twice weekly using digital calipers (volume={(length)$^2$×breadth/2}. In FIG. 32, each line represents the average volume of injected tumors over time in individual treatment groups with the standard deviation. Statistical analysis: one-way ANOVA at day 24 (*=p<0.05).

Figure 33:
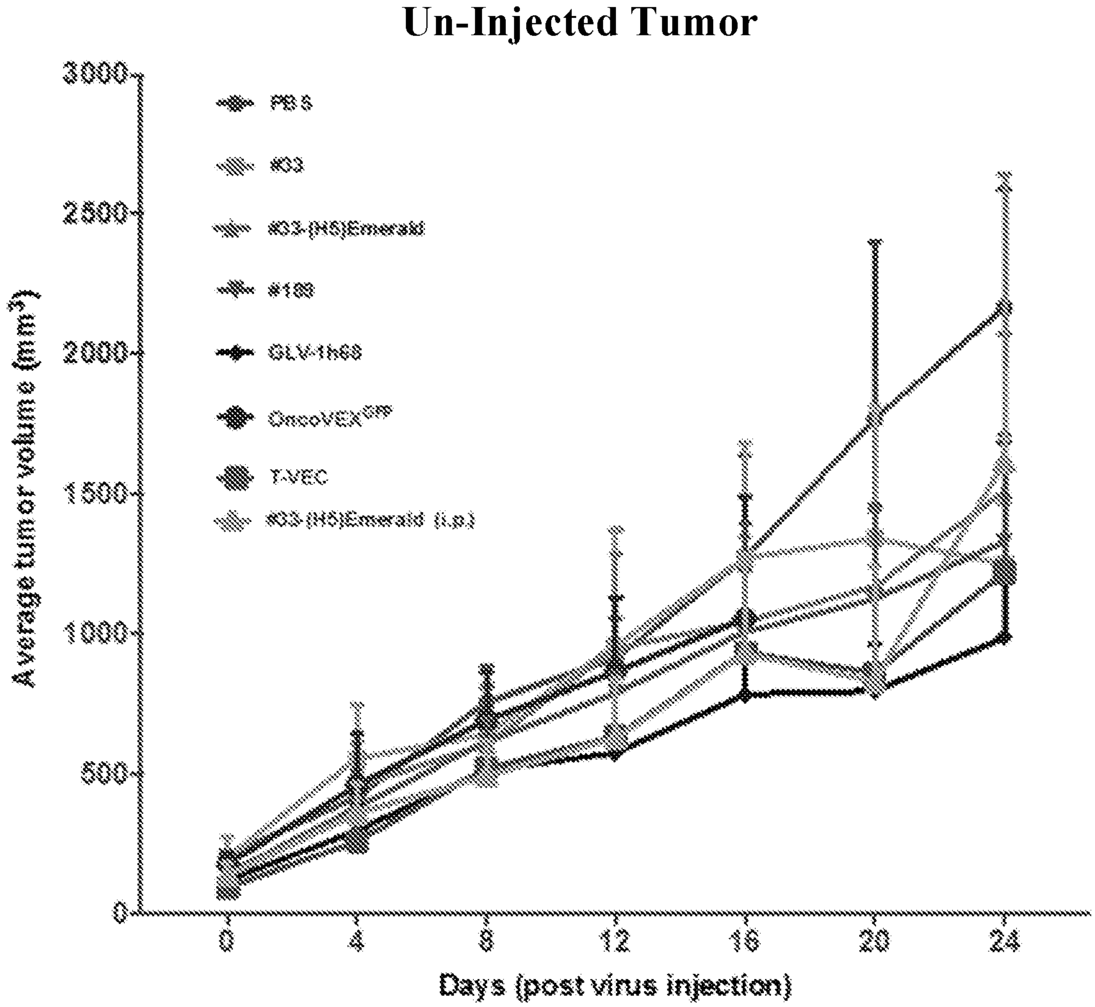
FIG. 33. Volume of un-injected tumors in A549 xenograft model. 3 weeks post-tumor cell A549 injections, the mice were sorted into different treatment groups (n=4 or 5) so as to obtain similar average tumor volume in each group (~200 $mm^3$) and the right-side tumor in each mouse was injected with $10^3$ PFUs of the indicated viruses (#33, #33-(H5) Emerald, GLV-1h68, OncoVEX$^{GFP}$, T-VEC, #189, PBS control) intra-tumorally or #33-(H5)Emerald injected intraperitoneally (i.p,). Tumor volumes for the un-injected tumor were measured twice weekly using digital calipers. Each line represents the average volume of injected tumors in individual treatment groups with the standard deviation. Statistical analysis: one-way ANOVA at day 24 (*=p<0.05).

Volume of un-injected tumors in A549 xenograft model. A549, human lung cancer cells, were cultured, trysinized, washed with PBS and resuspended in 1:1 PBS and matrigel to get $5\times10^6$ cells per 100 μL. 100 μL of the cell suspension was injected subcutaneously on each side of upper flank of athymic nude mice to generate 2 tumors per mouse. 3 weeks post-tumor cell injections, the mice were sorted into different treatment groups (n=4 or 5) so as to obtain similar average tumor volume in each group (~200 $mm^3$). After sorting, only the right-side tumor in each mouse was injected with $10^3$ PFUs of the indicated viruses (#33, #33-(H5)Emerald, GLV-1h68, OncoVEX$^{GFP}$, T-VEC, #189, PBS control) intra-tumorally, or #33-(H5)Emerald injected intraperitoneally (i.p.). Tumor volumes were measured twice weekly using digital calipers (volume={(length)$^2$×breadth/2}. In FIG. 33, each line represents the average volume of un-injected tumors over time in individual treatment groups with the standard deviation. Statistical analysis: one-way ANOVA at day 24 (*=p<0.05).

Figure 34A:
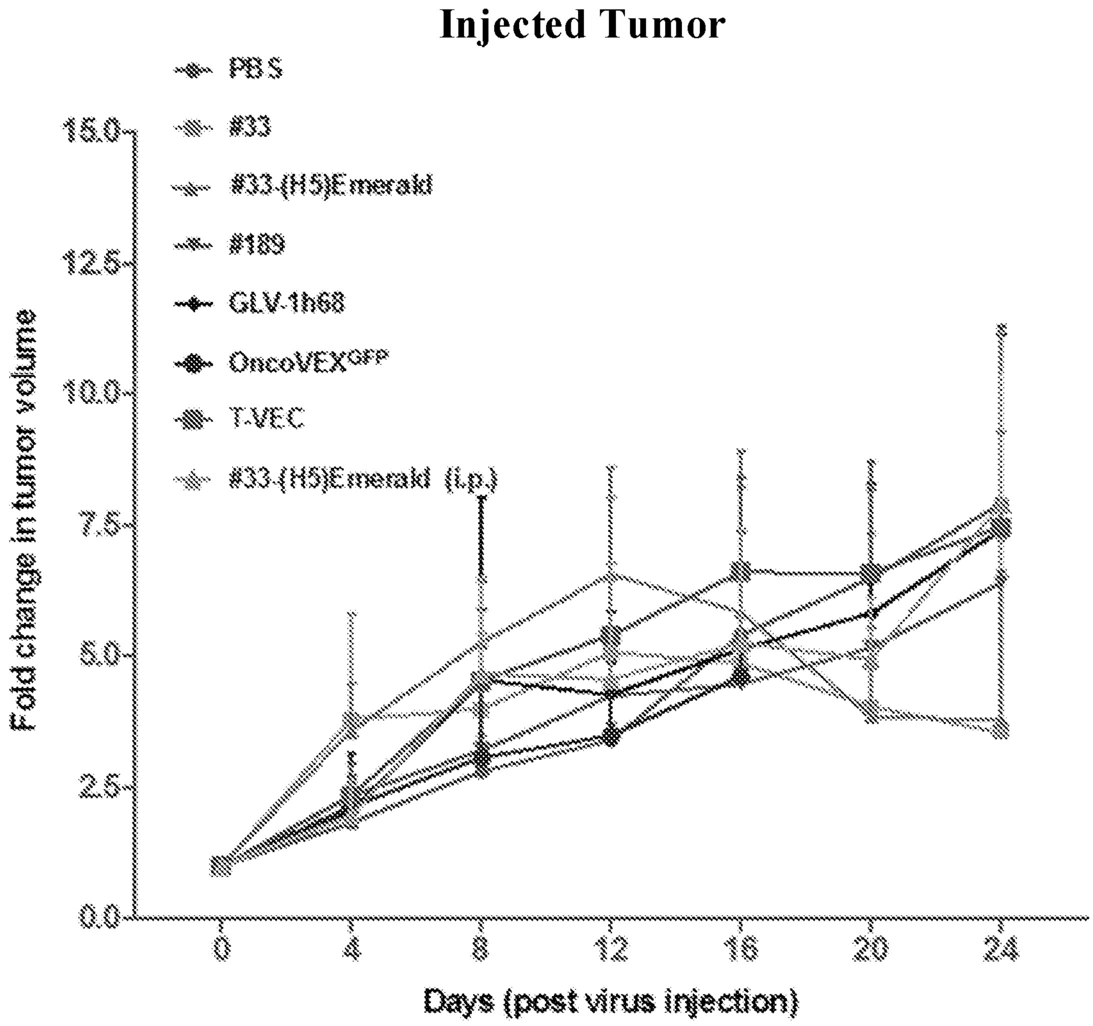
FIGS. 34A-34B. Fold change in tumor volume. 3 weeks post-tumor cell A549 injections, the mice were sorted into different treatment groups (n=4 or 5) so as to obtain similar average tumor volume in each group (~200 $mm^3$) and the right-side tumor in each mouse was injected with $10^3$ PFUs of the indicated viruses (#33, #33-(H5)Emerald, GLV-1h68, OncoVEX$^{GFP}$, T-VEC, #189, PBS control) intra-tumorally or #33-(H5)Emerald injected intraperitoneally (i.p,). Tumor volumes were measured twice weekly using digital calipers. The fold change in the tumor volume for injected (FIG. 34A) and un-injected (FIG. 34B) tumors was calculated by normalizing the tumor volumes at different time point with that at the time of virus injection (i.e., day 0).
Figure 34B:
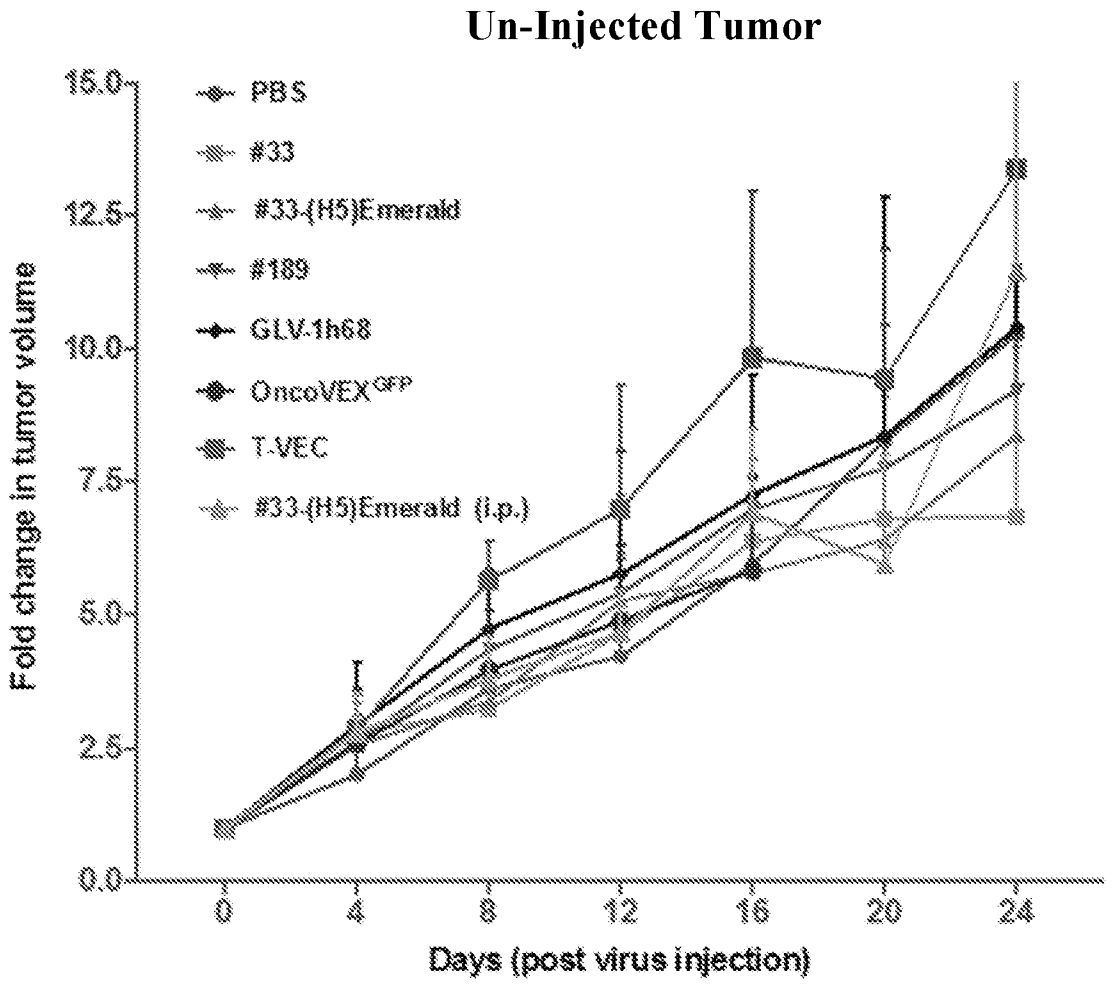

Fold change in injected and un-injected tumor volume. A549, human lung cancer cells, were cultured, trysinized, washed with PBS and resuspended in 1:1 PBS and matrigel to get $5\times10^6$ cells per 100 μL. 100 μL of the cell suspension was injected subcutaneously on each side of upper flank of athymic nude mice to generate 2 tumors per mouse. 3 weeks post-tumor cell injections, the mice were sorted into different treatment groups (n=4 or 5) so as to obtain similar average tumor volume in each group (~200 $mm^3$). After sorting, only the right-side tumor in each mouse was injected with $10^3$ PFUs of the indicated viruses (#33, #33-(H5) Emerald, GLV-1h68, OncoVEX$^{GFP}$, T-VEC, #189, PBS control) intra-tumorally, or #33-(H5)Emerald injected intraperitoneally (i.p.). Tumor volumes were measured twice weekly using digital calipers (volume={(length)$^2$×breadth/2}. Fold change in the tumor volume was calculated by normalizing the tumor volumes at different time points with that at the time of virus injection (i.e., day 0). Each line represents the average fold change in tumor volume in injected (FIG. 34A) and un-injected (FIG. 34B) tumors for individual treatment groups with the standard deviation. Statistical analysis: one-way ANOVA at day 24 (*=p<0.05).

Figure 35A:
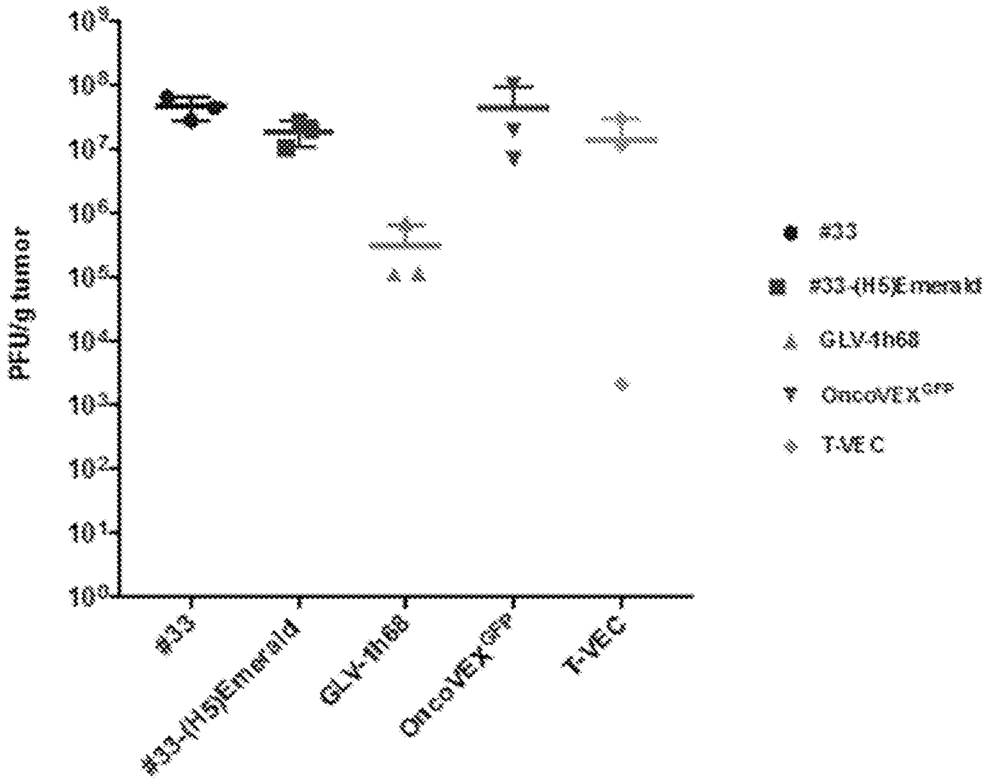
FIGS. 35A-35B. Bio-distribution of viruses in injected and un-injected tumors (A549 model). 3 weeks post-tumor cell A549 injections, the mice were sorted into different treatment groups (n=3) so as to obtain similar average tumor volume in each group (~200 $mm^3$) and only the right-side tumor in each mouse was injected with $10^3$ PFUs of the indicated viruses (#33, #33-(H5)Emerald, GLV-1h68, OncoVEX$^{GFP}$) intra-tumorally. Six days after virus injection, tumors as well as normal organs were harvested. Harvested tissues were weighed, chopped in small pieces and homogenized in 1 ml PBS using the BULLET BLENDER™ Gold homogenizer. Homogenates were subjected to 3 rounds of freeze-thaw cycle followed by 1 minute of sonication. The homogenates were spun down at 1000 rpm for 3 minutes and supernatants were collected. The supernatants were serially diluted and virus titer was determined using the standard plaque assay.
Figure 35B:
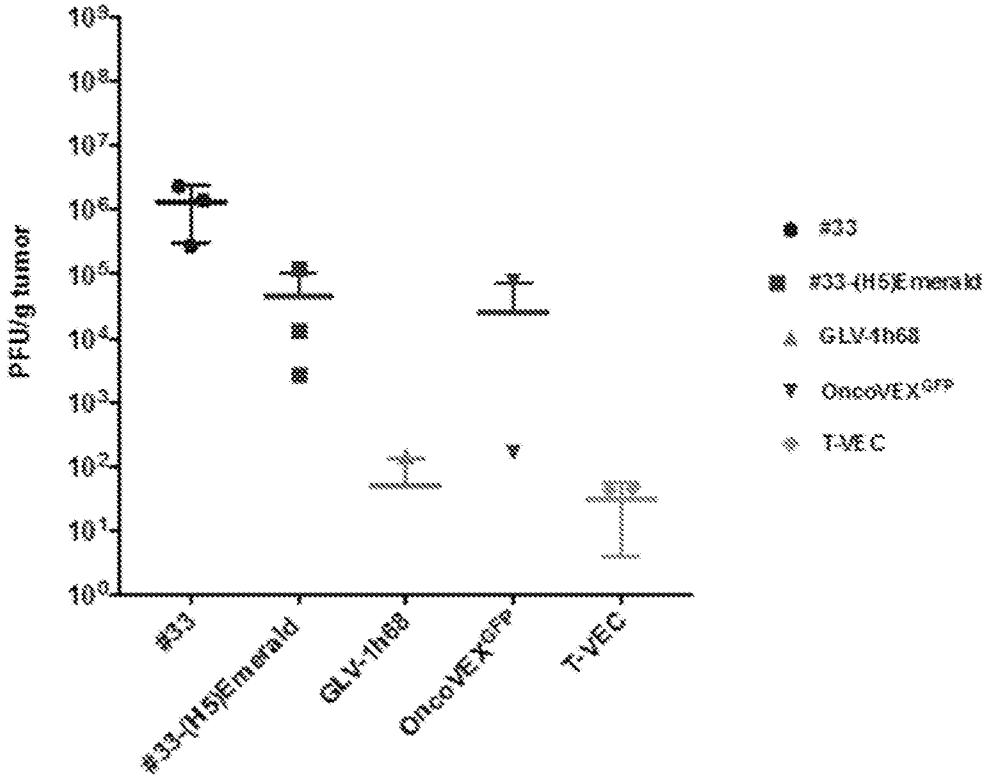

Bio-distribution of viruses in injected and un-injected tumors (A549 model). A549, human lung cancer cells, were cultured, trysinized, washed with PBS and resuspended in 1:1 PBS and matrigel to get $5\times10^6$ cells per 100 μL. 100 μL of the cell suspension was injected subcutaneously on each side of upper flank of athymic nude mice to generate 2 tumors per mouse. 3 weeks post-tumor cell injections, the mice were sorted into different treatment groups (n=3) so as to obtain similar average tumor volume in each group (~200 $mm^3$). After sorting, only the right-side tumor in each mouse was injected with $10^3$ PFUs of the indicated viruses (#33, #33-(H5)Emerald, GLV-1h68, OncoVEX$^{GFP}$, T-VEC) intra-tumorally. Six days after virus injection, tumors as well as normal organs were harvested. Harvested tissues were weighed, chopped in small pieces and homogenized in 1 ml PBS using the BULLET BLENDER™ Gold homogenizer. Homogenates were subjected to 3 rounds of freeze-thaw cycle followed by 1 minute of sonication. The homogenates were spun down at 1000 rpm for 3 minutes and supernatants were collected. The supernatants were serially diluted and virus titer for was determined using the standard plaque assay. FIG. 35A shows virus titer in PFU/g of tumor for injected tumors for each virus and FIG. 35B shows virus titer in PFU/g of tumor for un-injected tumors for each virus.

Figure 36:
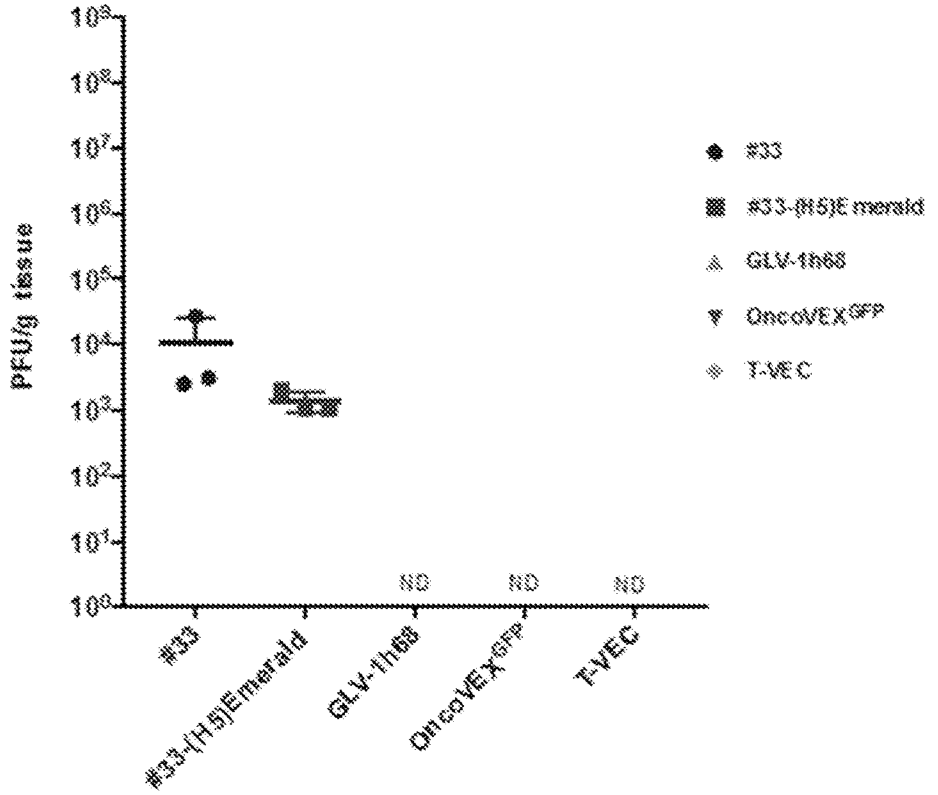
FIG. 36. Titer of viruses in the ovaries of mice (A549 model). 3 weeks post-tumor cell A549 injections, the mice were sorted into different treatment groups (n=3) so as to obtain similar average tumor volume in each group (~200 $mm^3$) and only the right-side tumor in each mouse was injected with $10^3$ PFUs of the indicated viruses (#33, #33-(H5)Emerald, GLV-1h68, OncoVEX$^{GFP}$, T-VEC) intra-tumorally. Six days after virus injection, tumors as well as normal organs were harvested. Harvested tissues were weighed, chopped in small pieces and homogenized in 1 ml PBS using the BULLET BLENDER™ Gold homogenizer. Homogenates were subjected to 3 rounds of freeze-thaw cycle followed by 1 minute of sonication. The homogenates were spun down at 1000 rpm for 3 minutes and supernatants were collected. The supernatants were serially diluted and virus titer was determined using the standard plaque assay.

Titer of viruses in the ovaries of mice (A549 model). A549, human lung cancer cells, were cultured, trysinized, washed with PBS and resuspended in 1:1 PBS and matrigel to get $5\times10^6$ cells per 100 μL. 100 μL of the cell suspension was injected subcutaneously on each side of upper flank of athymic nude mice to generate 2 tumors per mouse. 3 weeks post-tumor cell injections, the mice were sorted into different treatment groups (n=3) so as to obtain similar average tumor volume in each group (~200 $mm^3$). After sorting, only the right-side tumor in each mouse was injected with $10^3$ PFUs of the indicated viruses (#33, #33-(H5)Emerald, GLV-1h68, OncoVEX$^{GFP}$, T-VEC) intra-tumorally. Six days after virus injection, tumors as well as normal organs were harvested. Harvested tissues were weighed, chopped in small pieces and homogenized in 1 ml PBS using the BULLET BLENDER™ Gold homogenizer. Homogenates were subjected to 3 rounds of freeze-thaw cycle followed by 1 minute of sonication. The homogenates were spun down at 1000 rpm for 3 minutes and supernatants were collected. The supernatants were serially diluted and virus titer was determined using the standard plaque assay. FIG. 36 shows viral titer in PFU/g of tissue (ovaries) for each virus. **ND means the virus was not detected.

Figure 37:
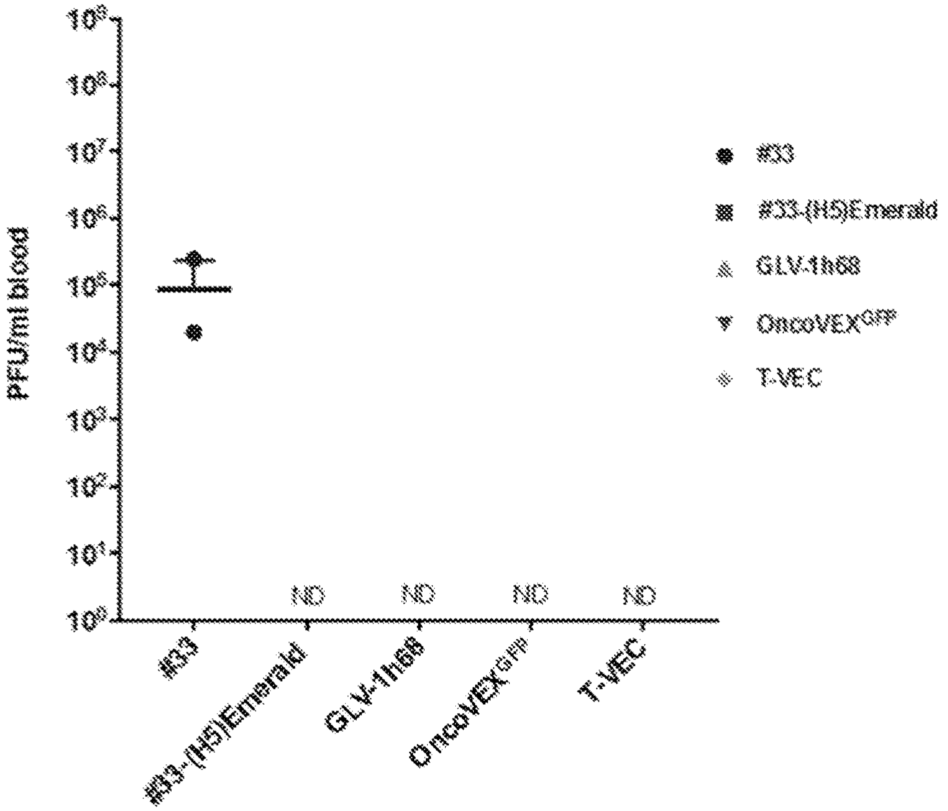
FIG. 37. Virus titer in blood 20 days post-virus injection. 3 weeks post-tumor cell A549 injections, the mice were sorted into different treatment groups (n=3) so as to obtain similar average tumor volume in each group (~200 $mm^3$) and only the right-side tumor in each mouse was injected with $10^3$ PFUs of the indicated viruses (#33, #33-(H5) Emerald, GLV-1h68, OncoVEX$^{GFP}$, T-VEC) intra-tumorally. Blood was collected from mice (n=3) through facial vein puncture. After 3 freeze-thaw cycles, blood was serially diluted and virus titer was determined using standard plaque assay.
Figure 38:
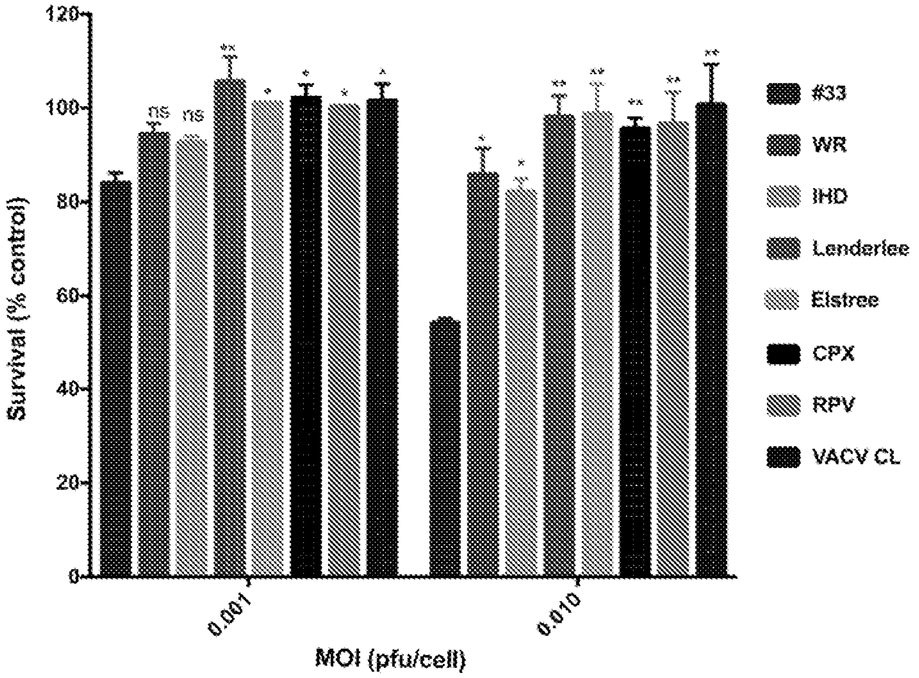
FIG. 38. The chimeric virus #33 is more potent than the parental viruses in killing lung cancer cells (A549). Cytotoxicity assay: 5000 cells were plated in each well of a 96-well plate. Next day, cells were infected with the chimeric virus #33 or the parental viruses at the indicated multiplicity of infection (MOI) or were mock-infected. Cell viability was determined using CELLTITER 96™ AQueous One Solution (Promega; Cat #G3581), 72 hours post-infection. Survival of infected cells was calculated relative to that of mock-infected cells.
Figure 39:
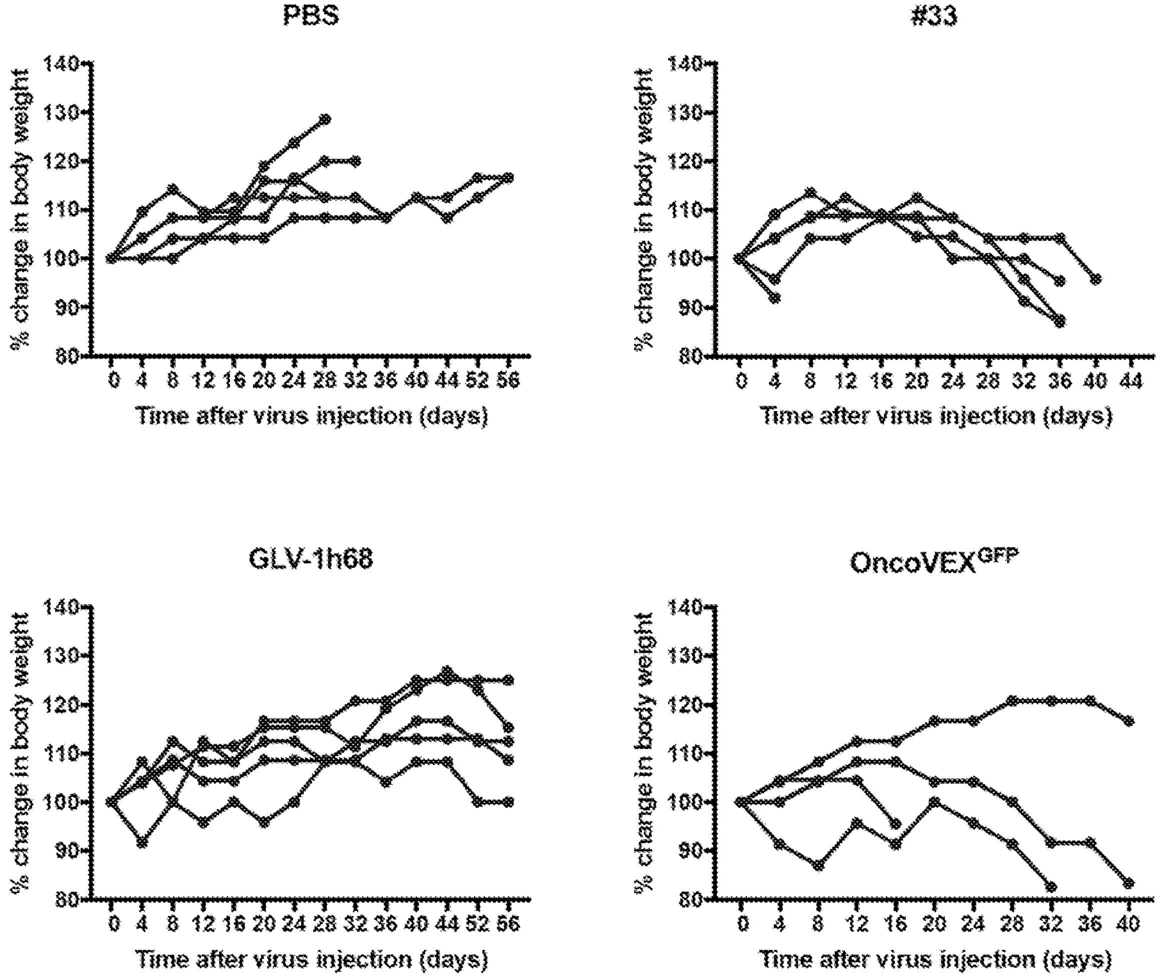
FIG. 39. Change in body weight after treatment. A549, human lung cancer cells, were cultured, trysinized, washed with PBS and resuspended in 1:1 PBS and matrigel to get a $5\times10^6$ cells per 100 μL. 100 μL of the cell suspension was injected sub-cutaneously on each side of upper flank of athymic nude mice to generate 2 tumors per mouse. 3 weeks post-tumor cell injections, the mice were sorted into different treatment groups (n=4 or 5) so as to obtain similar average tumor volume in each group (~200 $mm^3$). After sorting, only the right-side tumor in each mouse was injected $10^3$ PFUs of the indicated viruses, intra-tumorally. Mice were weighed twice weekly and percent change in their weight has been plotted. Each line represents weight of an individual mouse.
Figure 39:
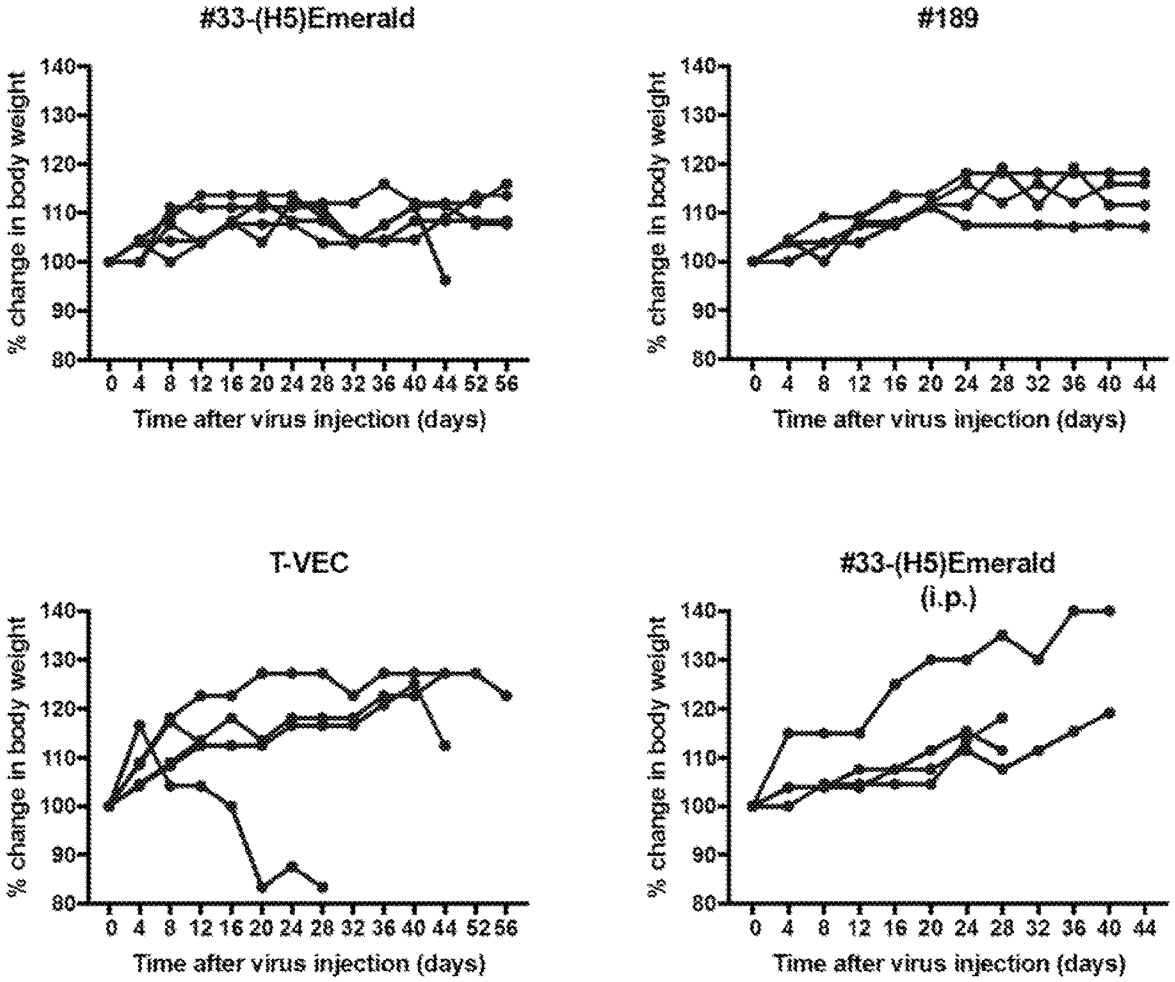
Figure 40:
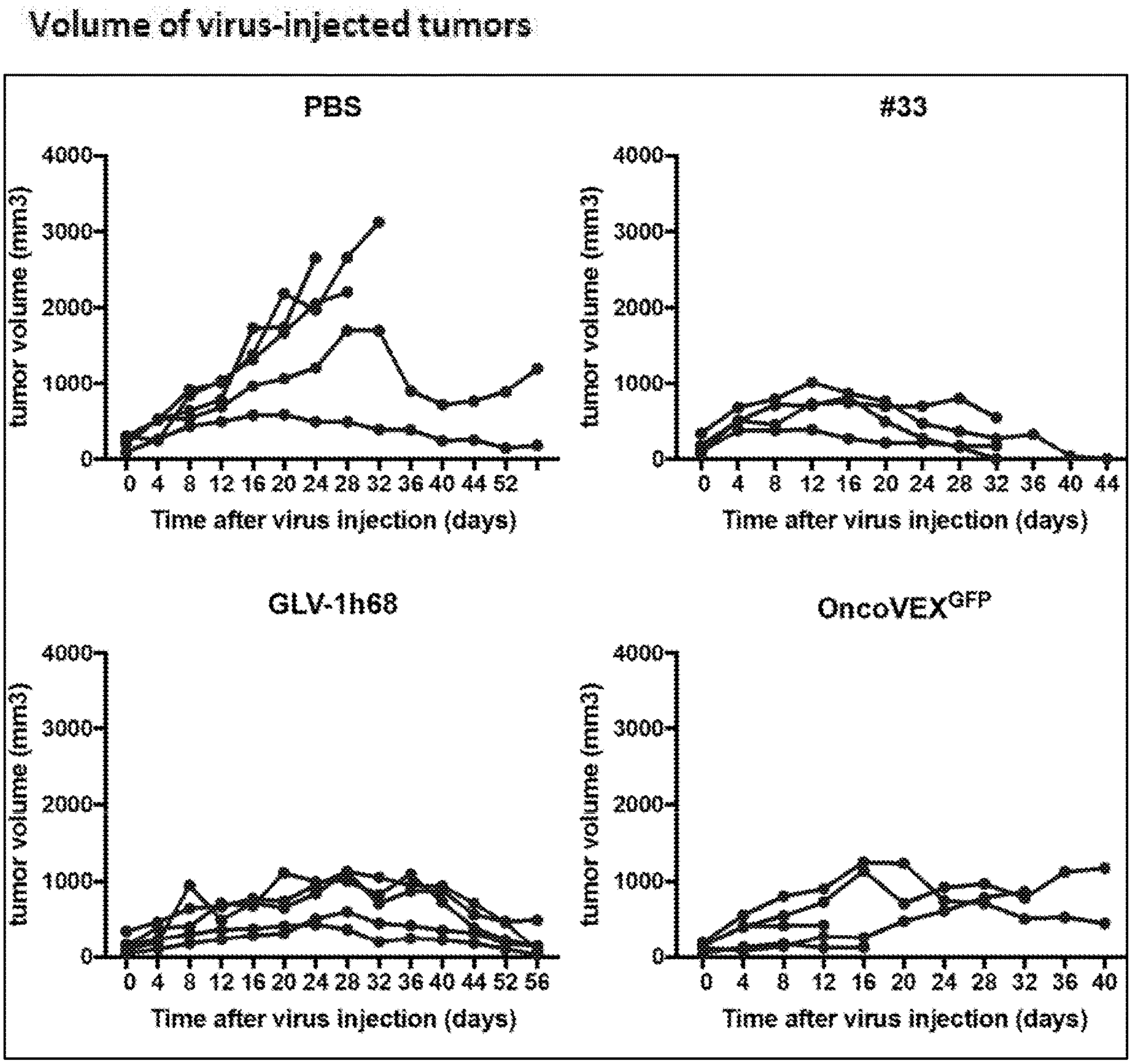
FIG. 40. Tumor regression. A549, human lung cancer cells, were cultured, trysinized, washed with PBS and resuspended in 1:1 PBS and matrigel to get a $5\times10^6$ cells per 100 μL. 100 μL of the cell suspension was injected sub-cutaneously on each side of upper flank of athymic nude mice to generate 2 tumors per mouse. 3 weeks post-tumor cell injections, the mice were sorted into different treatment groups (n=4 or 5) so as to obtain similar average tumor volume in each group (~200 $mm^3$). After sorting, only the right-side tumor in each mouse was injected $10^3$ PFUs of the indicated viruses, intra-tumorally. Volume of tumors (both injected and un-injected) were measured twice weekly, using digital caliper (volume=$\{(length)^2\times breadth/2\}$. Each line represents tumor volume of individual mouse.
Figure 40:
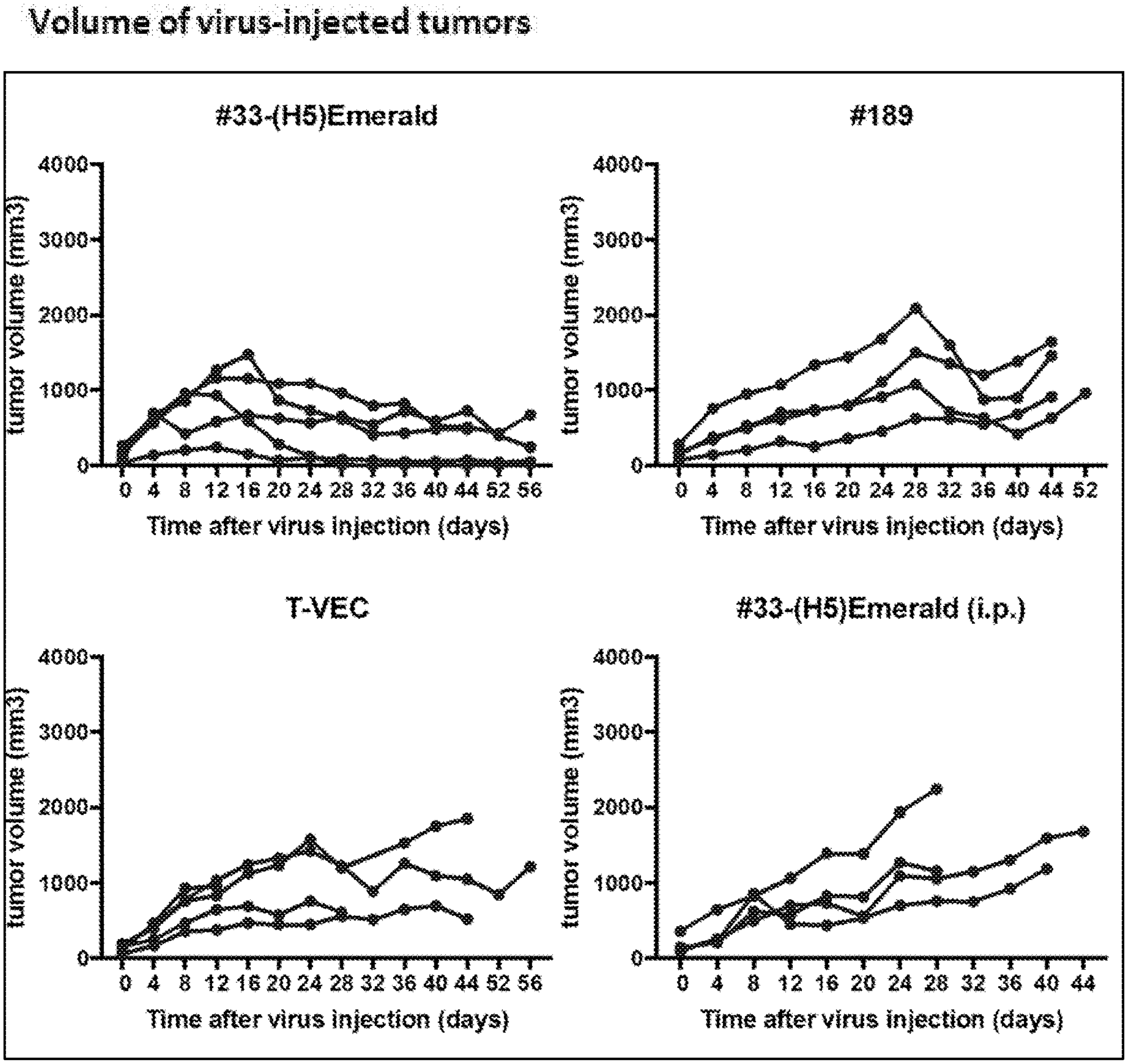
Figure 40:
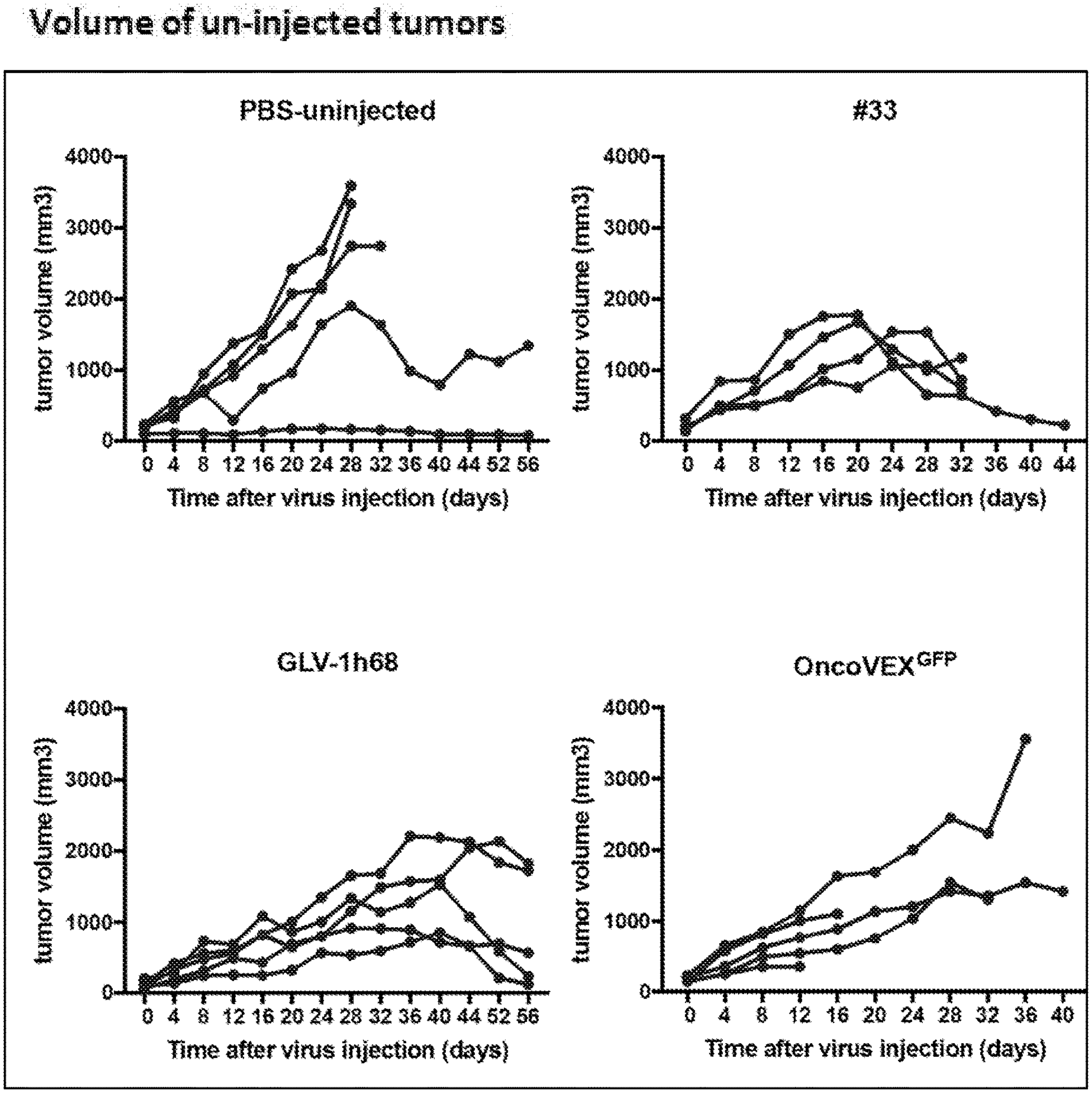
Figure 40:
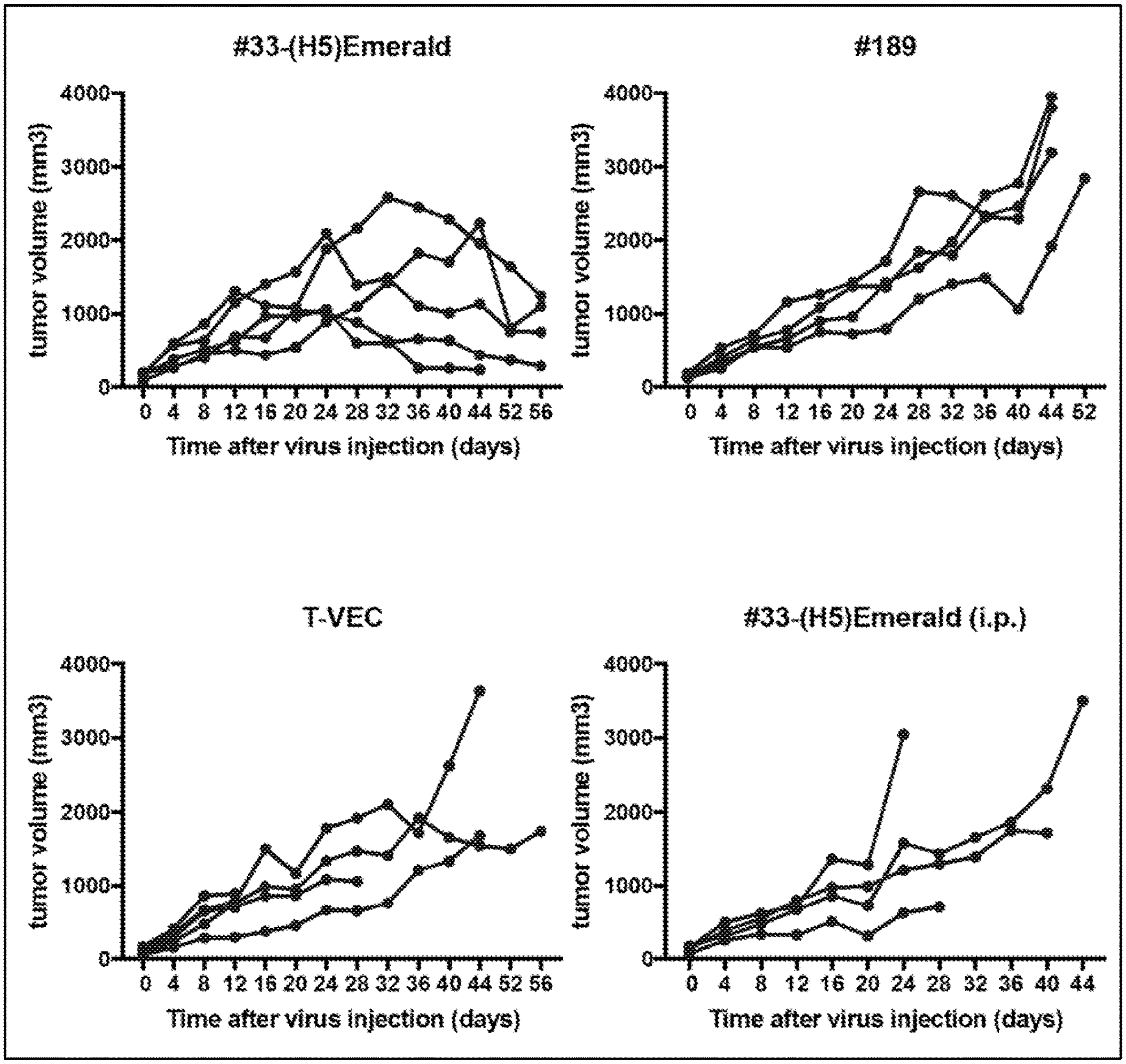
Figure 41:
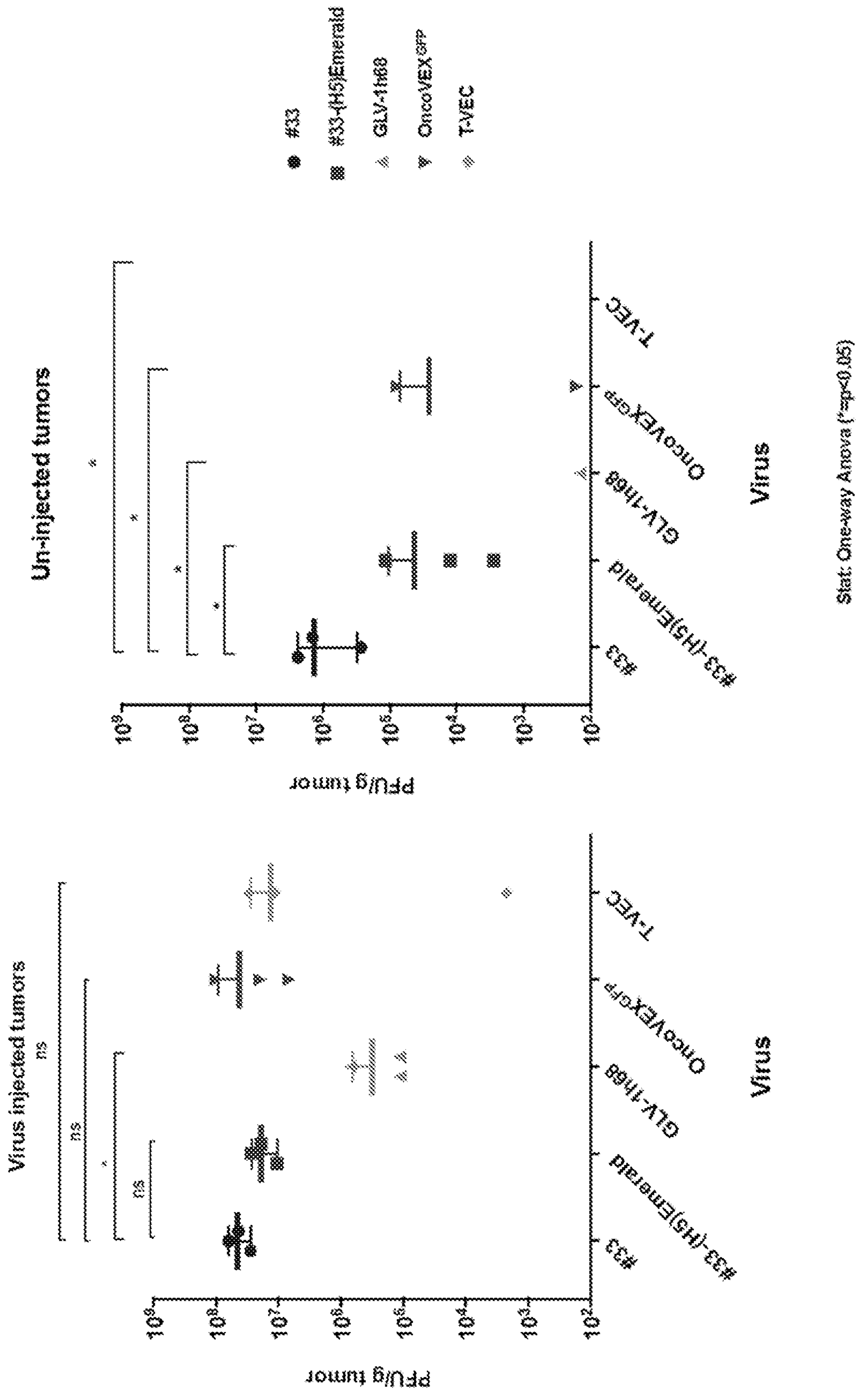
FIG. 41. Virus titer in injected and un-injected tumors 7 days post-infection. A549, human lung cancer cells, were cultured, trysinized, washed with PBS and resuspended in 1:1 PBS and matrigel to get a $5\times10^6$ cells per 100 μL. 100 μL of the cell suspension was injected sub-cutaneously on each side of upper flank of athymic nude mice to generate 2 tumors per mouse. 3 weeks post-tumor cell injections, the mice were sorted into different treatment groups (n=3) so as to obtain similar average tumor volume in each group (~200 $mm^3$). After sorting, only the right-side tumor in each mouse was injected $10^3$ PFUs of the indicated viruses, intra-tumorally. Six days after after virus injection tumors as well as normal organs were harvested. Harvested tissues were weighed, chopped in small pieces and homogenized in 1 ml PBS using the BULLET BLENDER™ Gold homogenizer. Homogenates were subjected to 3 rounds of freeze-thaw cycle followed by 1 minute of sonication. The homogenates were spun down at 1000 rpm for 3 minutes and supernatants were collected. The supernatants were serially diluted and virus titer were determined using the standard plaque assay.
Figure 42:
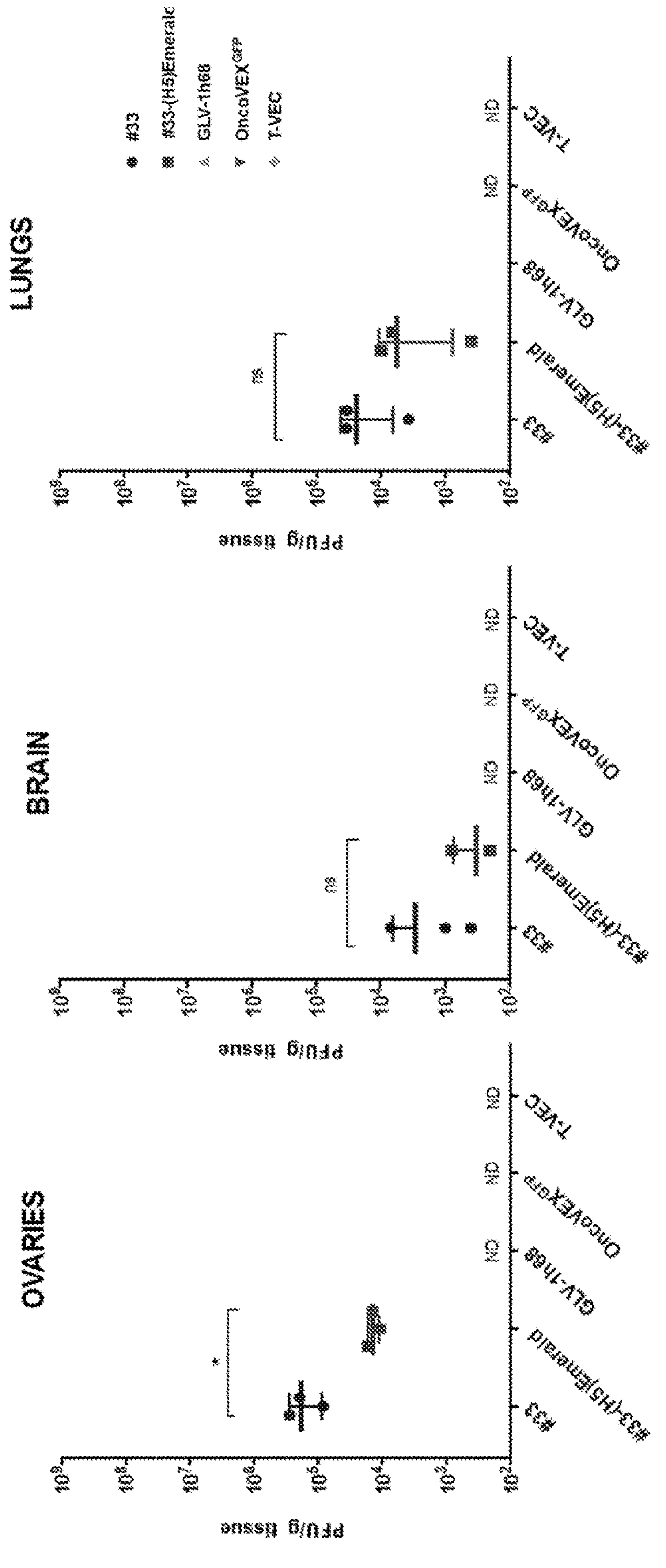
FIG. 42. Biod-distribution of viruses. A549, human lung cancer cells, were cultured, trysinized, washed with PBS and resuspended in 1:1 PBS and matrigel to get a $5\times10^6$ cells per 100 μL. 100 μL of the cell suspension was injected sub-cutaneously on each side of upper flank of athymic nude mice to generate 2 tumors per mouse. 3 weeks post-tumor cell injections, the mice were sorted into different treatment groups (n=3) so as to obtain similar average tumor volume in each group (~200 $mm^3$). After sorting, only the right-side tumor in each mouse was injected $10^3$ PFUs of the indicated viruses, intra-tumorally. Six days after after virus injection tumors as well as normal organs were harvested. Harvested tissues were weighed, chopped in small pieces and homogenized in 1 ml PBS using the BULLET BLENDER™ Gold homogenizer. Homogenates were subjected to 3 rounds of freeze-thaw cycle followed by 1 minute of sonication. The homogenates were spun down at 1000 rpm for 3 minutes and supernatants were collected. The supernatants were serially diluted and virus titer was determined using the standard plaque assay.
Figure 42:
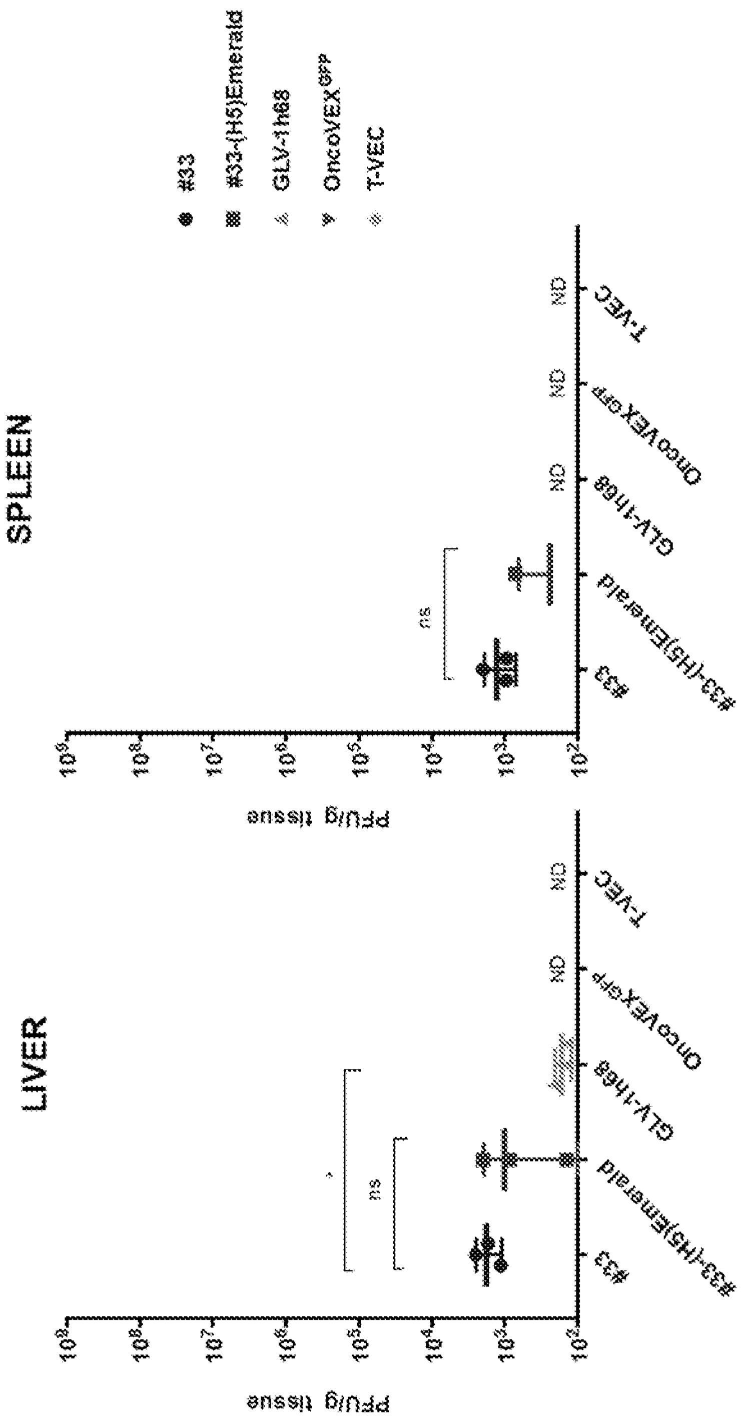
Figure 43:
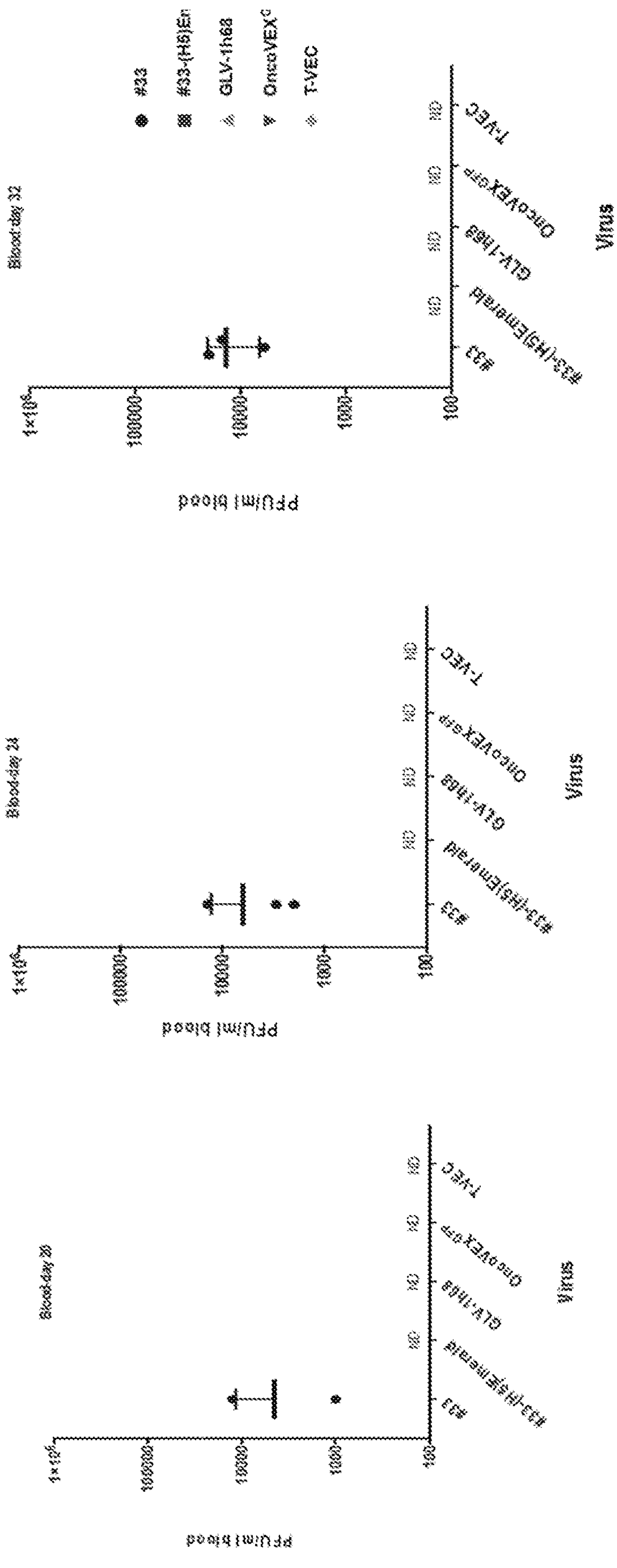
FIG. 43. Virus titer in the blood of injected mice. Blood was collected from the facial vein of A549 tumor-bearing mice at different time points after intra-tumoral injection of 1000 pfu of the indicted viruses. Virus in the blood samples were titered using the standard plaque assay technique. No detectable virus in urine for up to day 10 post-injection.
Figure 43:
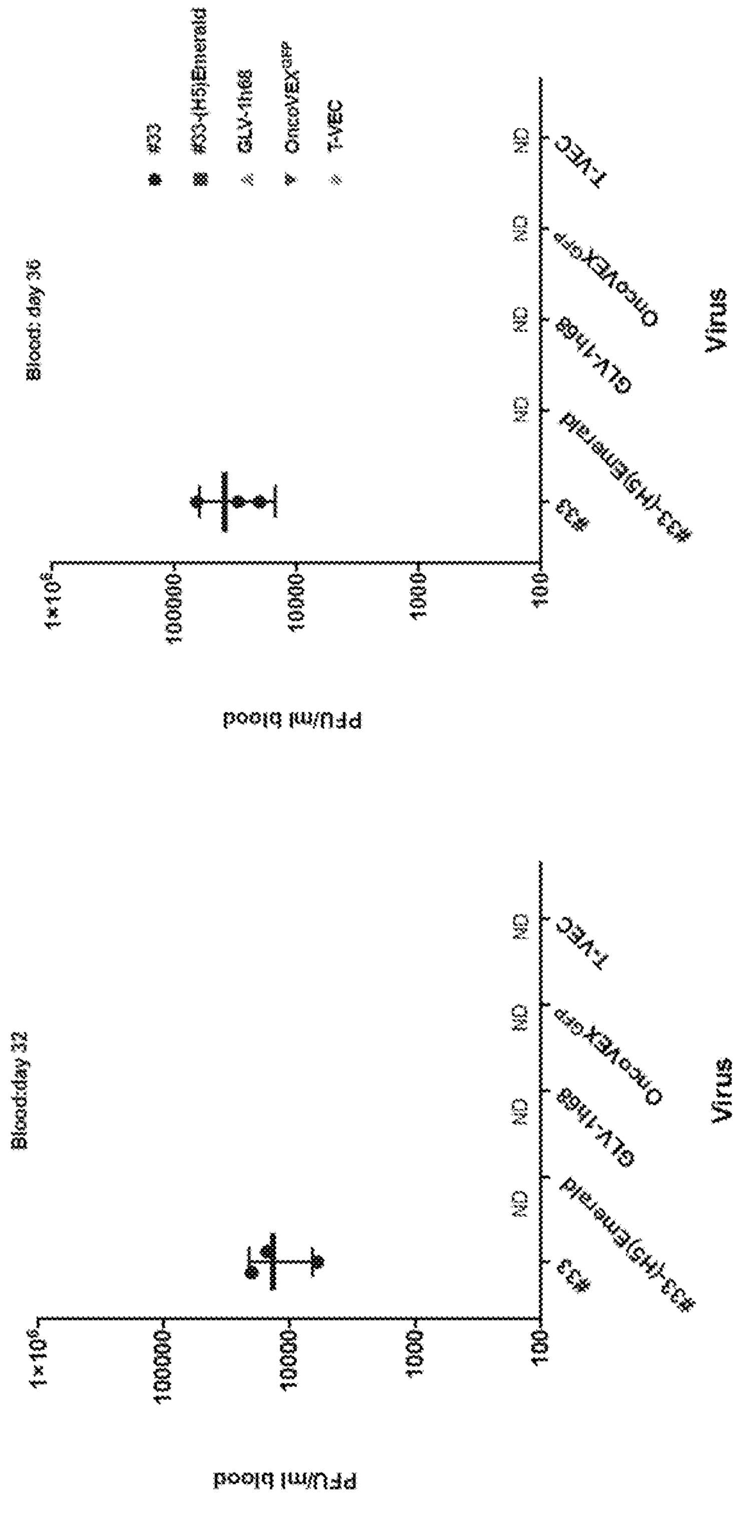
Figure 44:
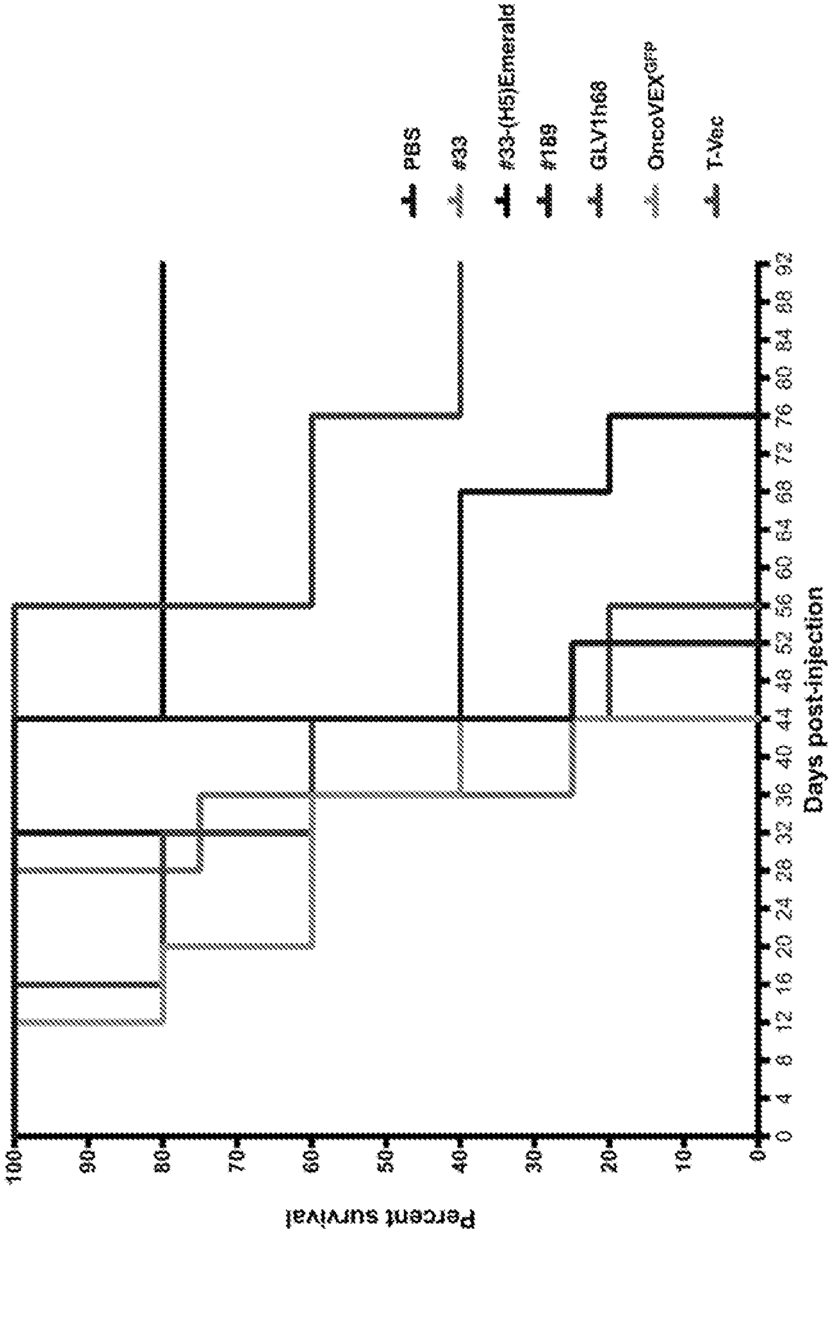
FIG. 44. Survival of mice after virus injection. A549, human lung cancer cells, were cultured, trysinized, washed with PBS and resuspended in 1:1 PBS and matrigel to get a $5\times10^6$ cells per 100 μL. 100 μL of the cell suspension was injected sub-cutaneously on each side of upper flank of athymic nude mice to generate 2 tumors per mouse. 3 weeks post-tumor cell injections, the mice were sorted into different treatment groups (n=3) so as to obtain similar average tumor volume in each group (~200 $mm^3$). After sorting, only the right-side tumor in each mouse was injected $10^3$ PFUs of the indicated viruses, intra-tumorally. Tumor volume was measure twice weekly using digital calipers and mice were euthanised when one of the bilateral tumors exceeded the tumor burden (3000 $mm^3$) or the mice became sick (lost >20% body weight) due to virus treatment.
Figure 45A:
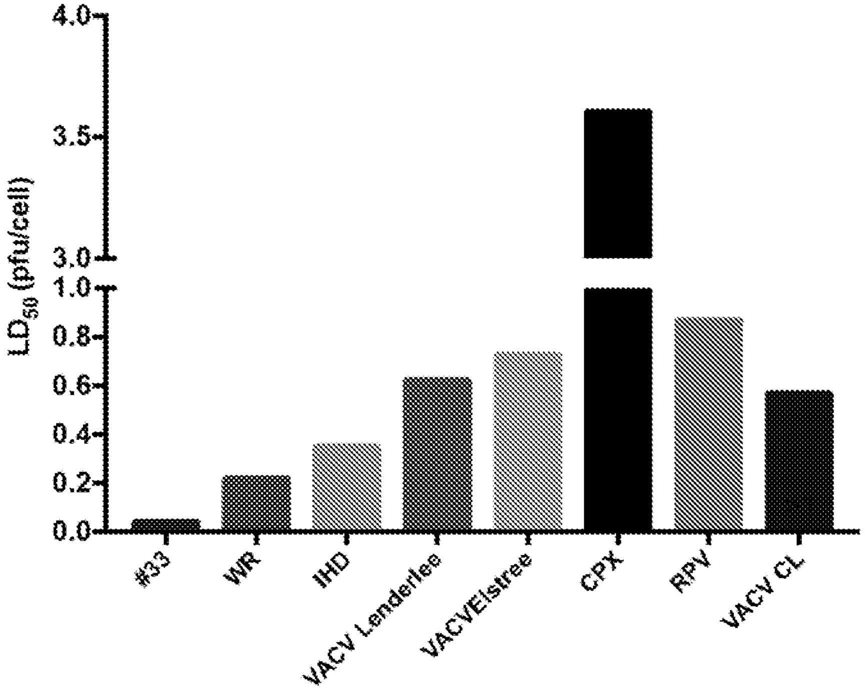
FIGS. 45A-45C. Comparison of cytotoxic potential of the chimeric #33 and parental poxviruses in A549.
Figure 45B:
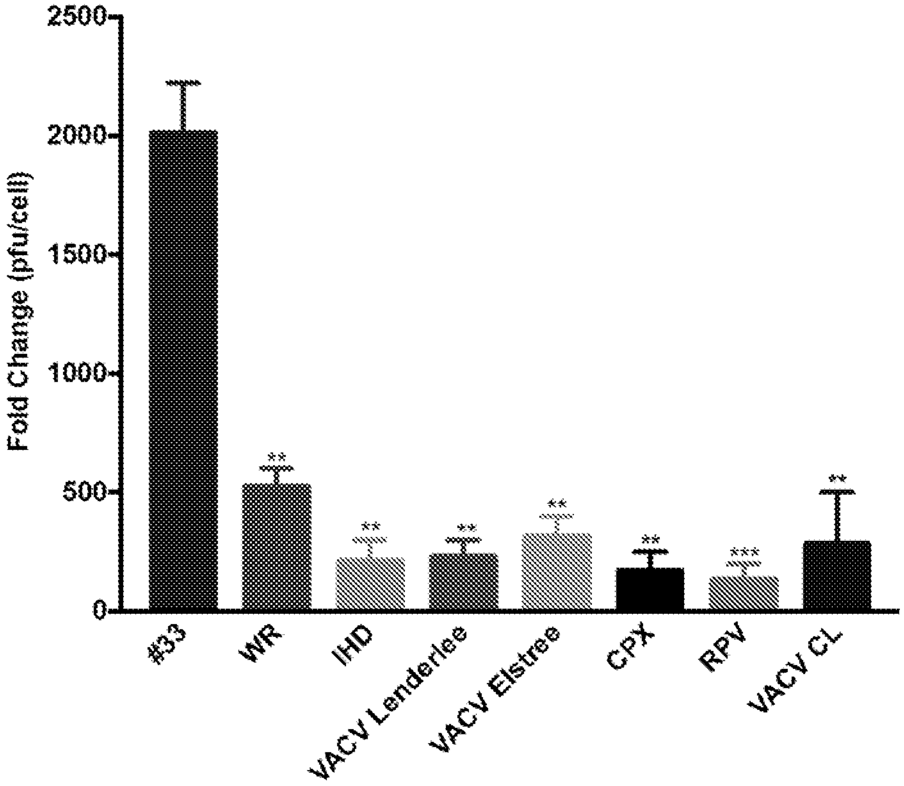
Figure 45C:
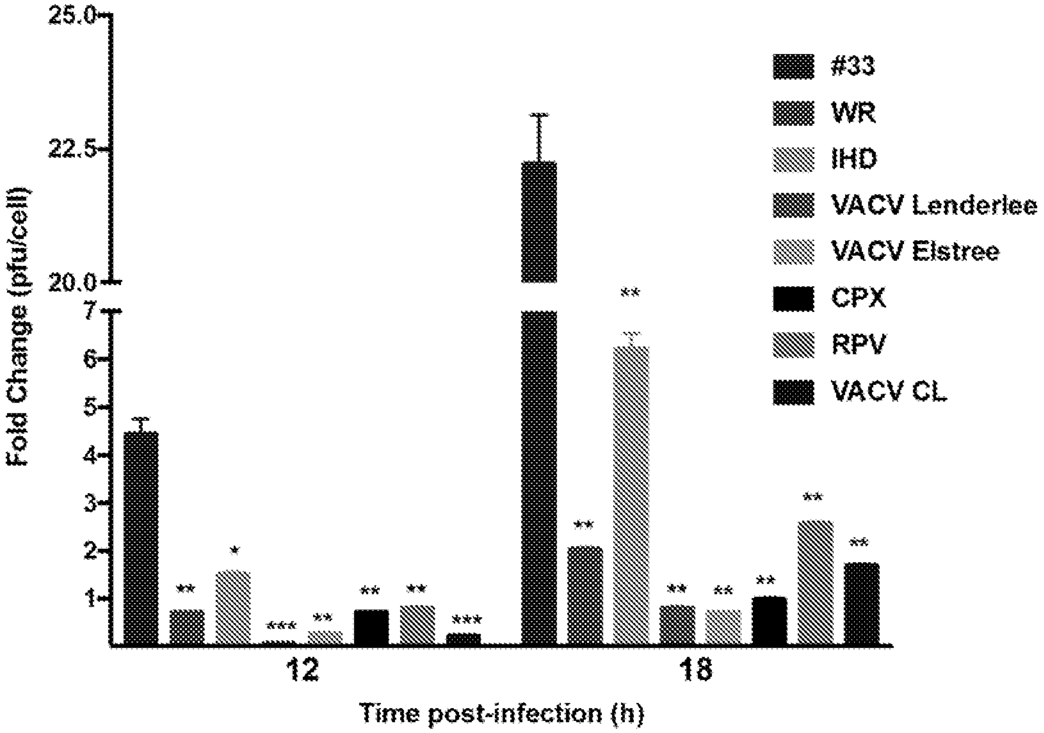
Figure 46A:
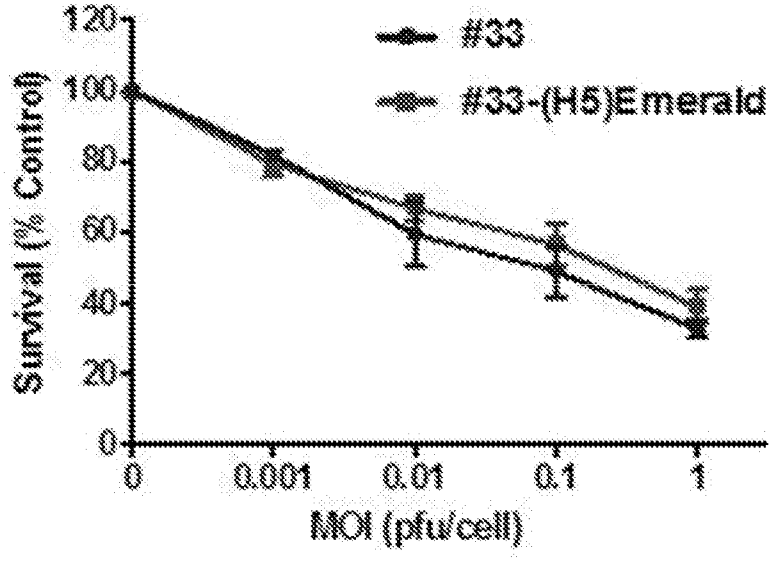
FIGS. 46A-46B. A549 cells were infected with #33 or #33-(H5)Emerald that has the J2R (TK) gene replaced with Emerald (green) expression cassette, at different MOIs.
Figure 46B:
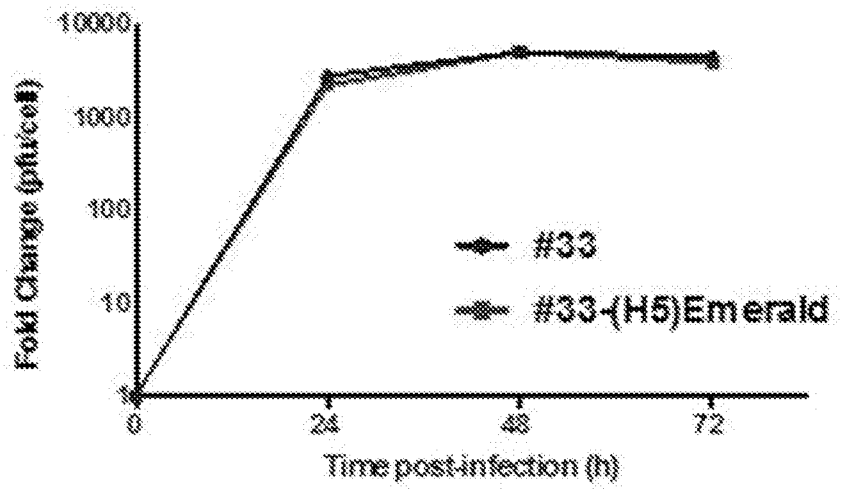
Figure 47A:
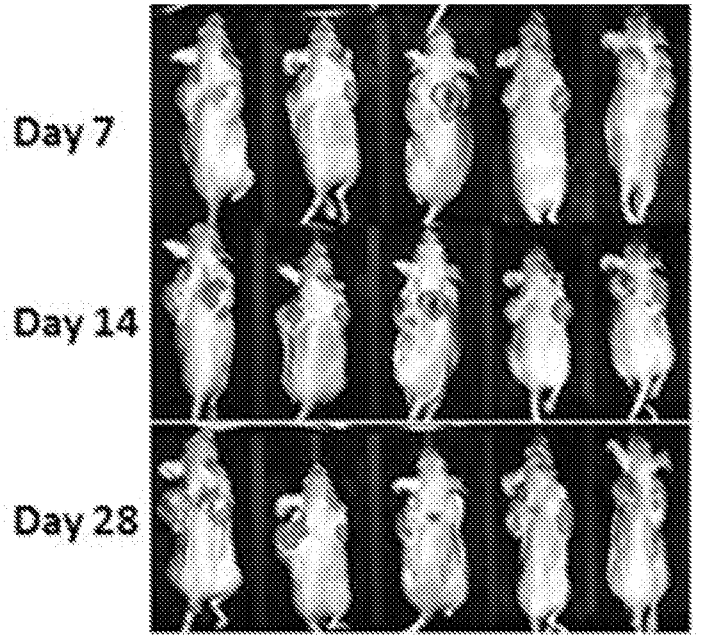
FIGS. 47A-47B.
Figure 47B:
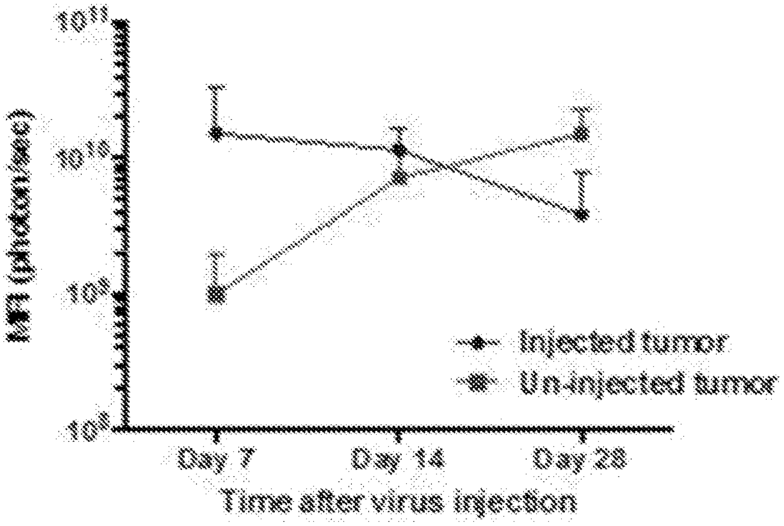
Figure 48A:
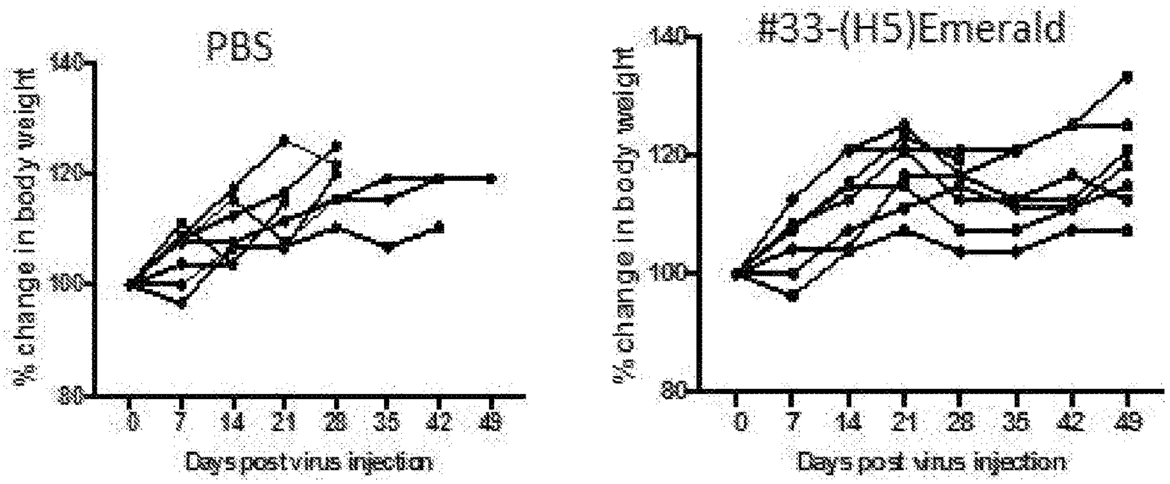
FIGS. 48A-48D.
Figure 48B:
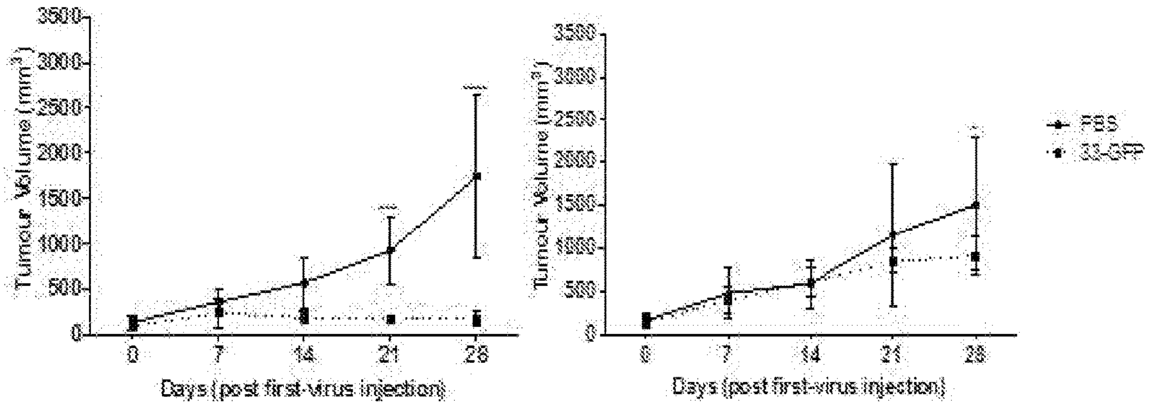
Figure 48C:
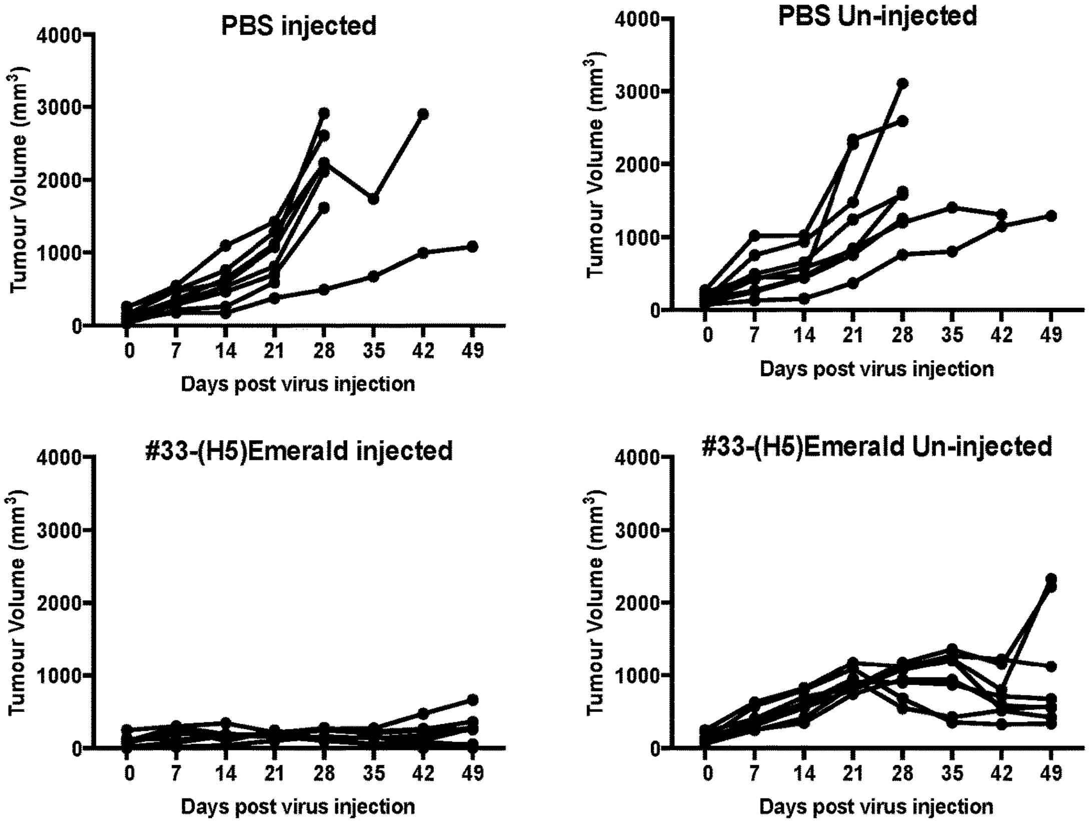
Figure 48D:
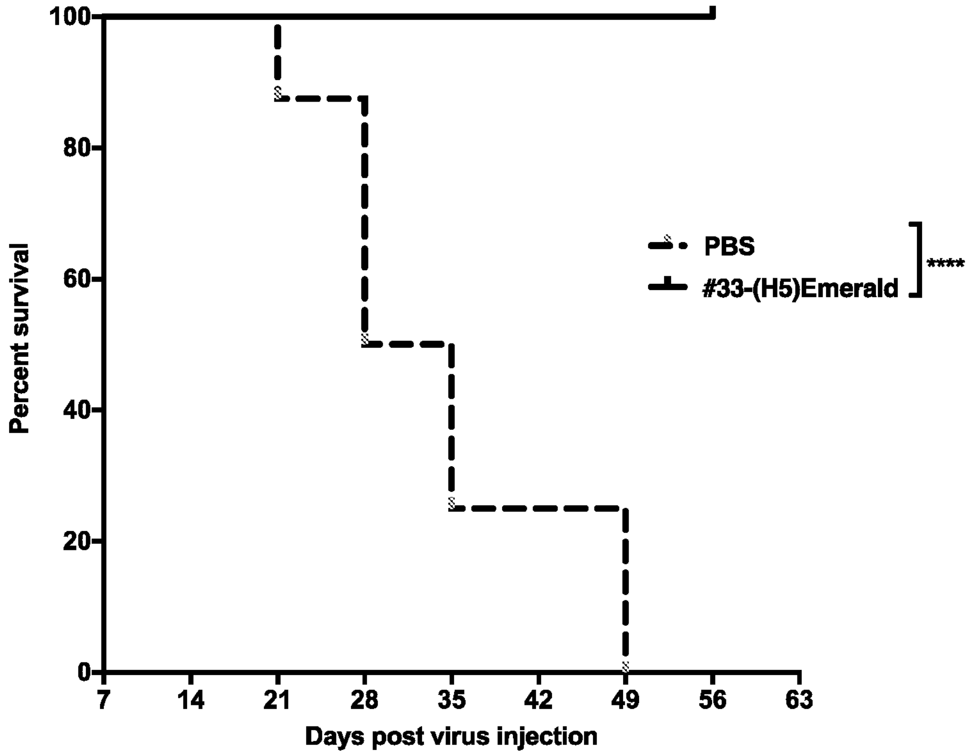
Figure 49A:
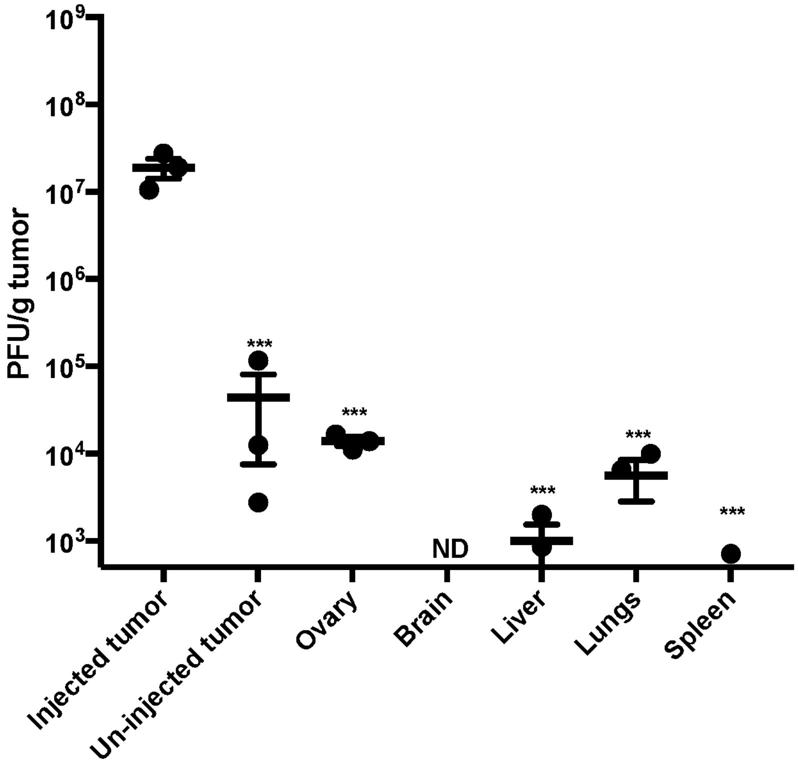
FIGS. 49A-49C.
Figure 49A:
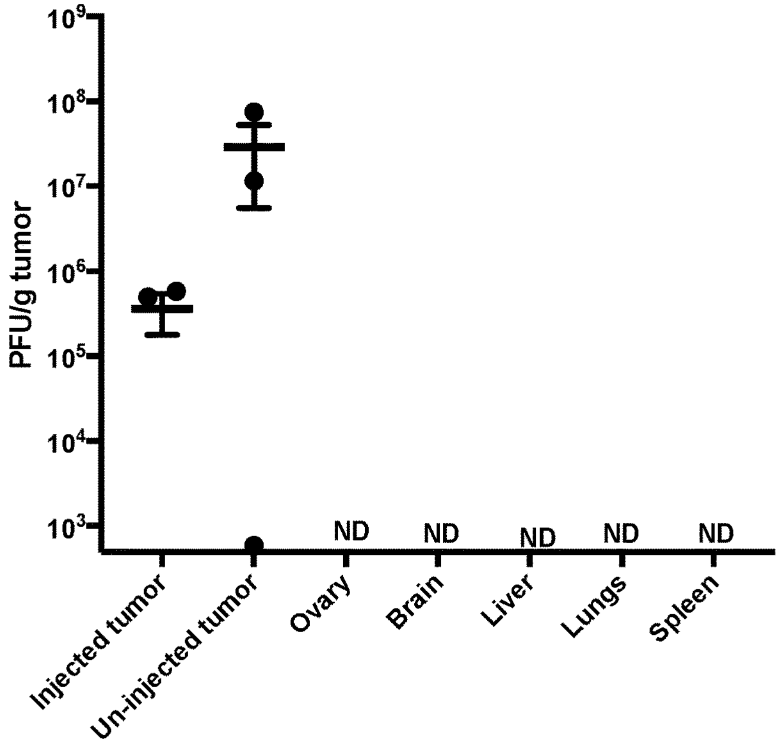
Figure 49B:
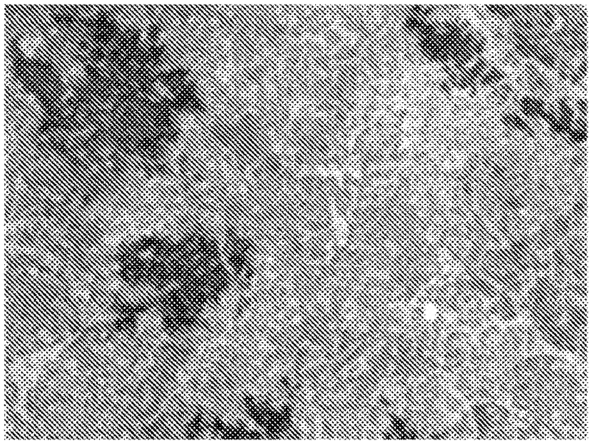
Figure 49B:
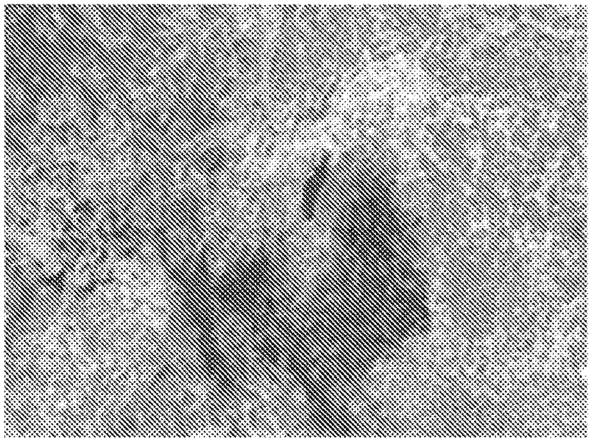
Figure 49B:
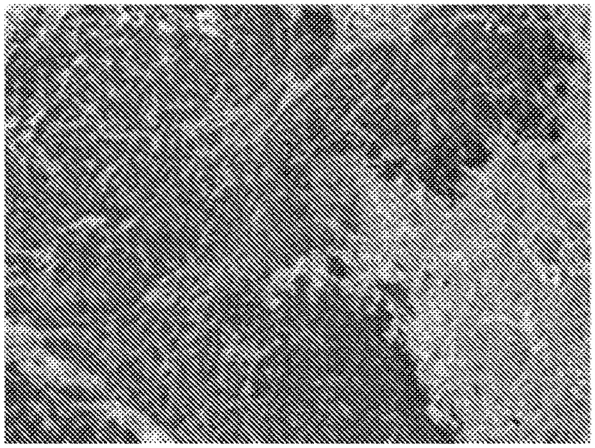
Figure 49C:
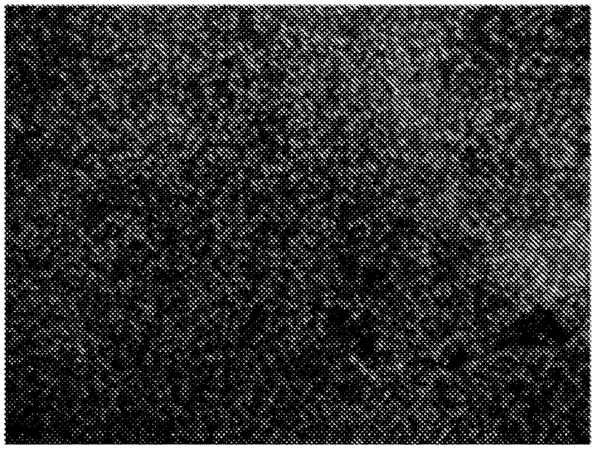
Figure 49C:
Figure 50:
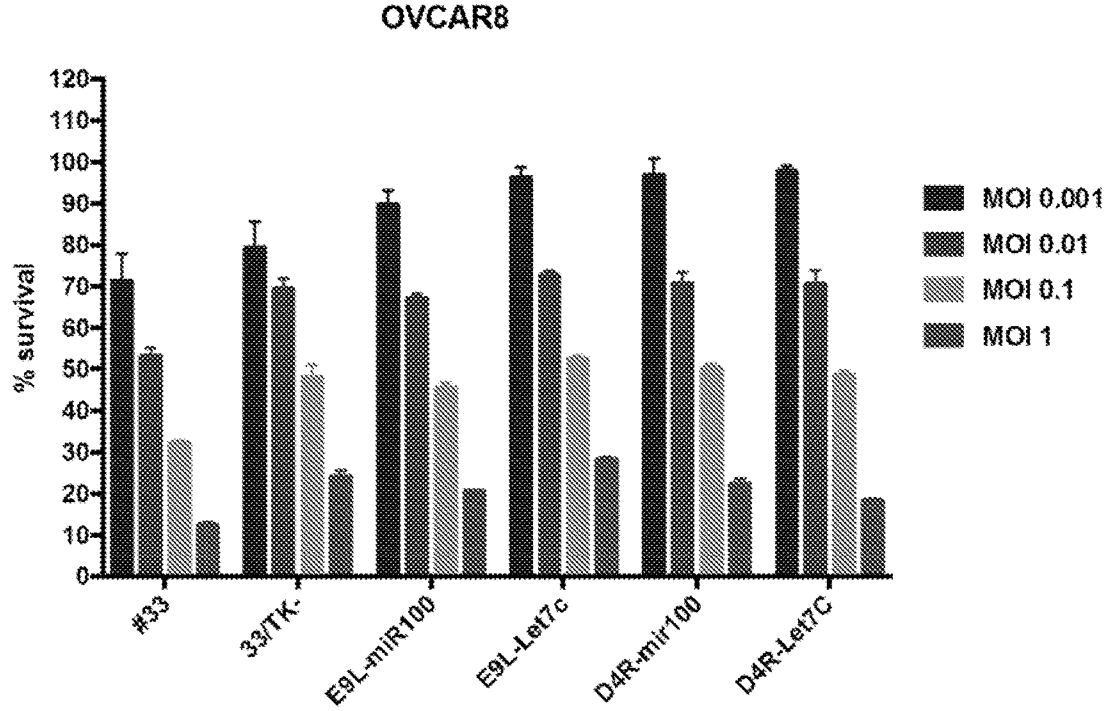
FIG. 50. In vitro cytotoxicity in OVCAR8 cells (72 h post-infection). 5000 OVCAR8 (human ovarian cancer) cells were plated in each well of a 96-well plate. Next day, cells were infected with the chimeric virus #33 or TK-deleted #33 (#33/TK−) or #33 viruses with miR100 and Let-7c target sequences inserted in the the essential viral genes E9L or D4R. Infection was performed at indicated multiplicity of infections (MOIs). Cell viability was determined using CELLTITER 96™ AQueous One Solution (Promega; Cat #G3581), 72 hours post-infection. Survival of infected cells was calculated relative to that of mock-infected cells.
Figure 51:
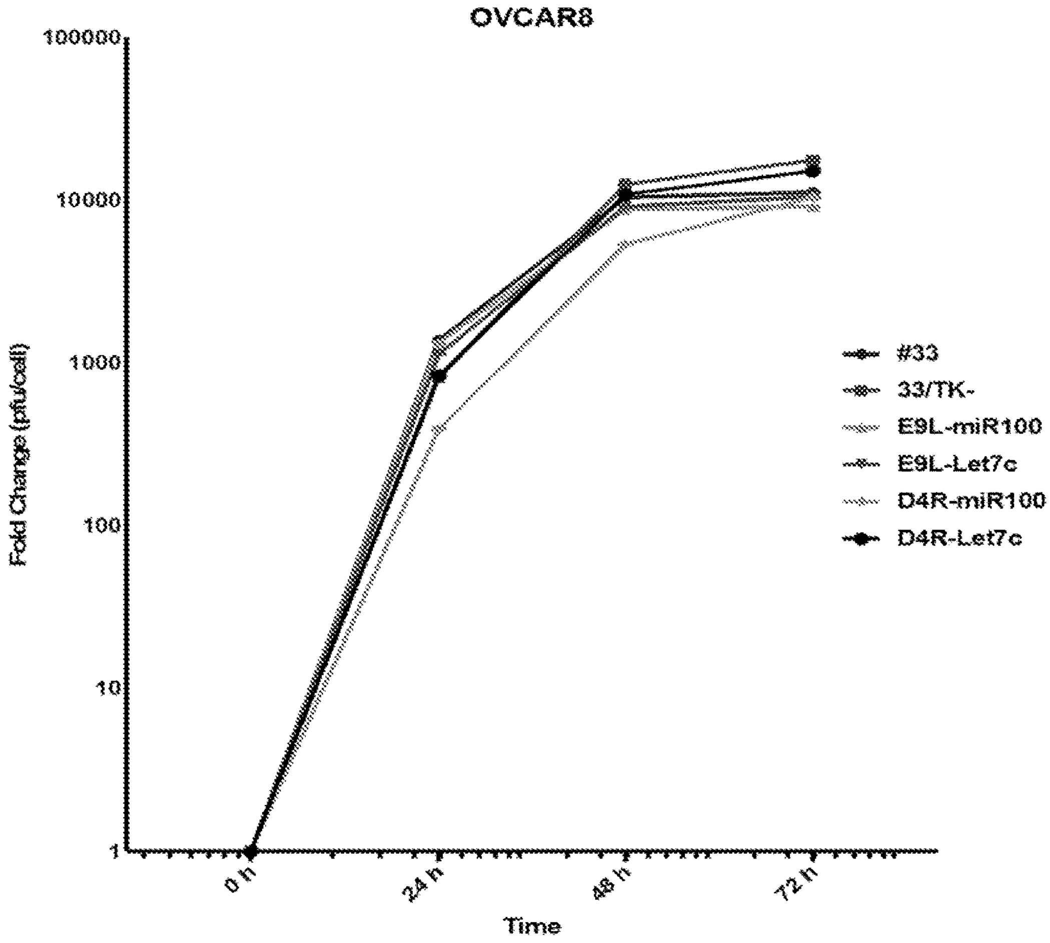
FIG. 51. Growth kinetics of viruses in OVCAR8 cells. OVCAR8 cells were infected with the indicated viruses at an MOI 0.03 pfu in 6-well plates. Cell lysates from the infected wells were collected 24, 48 and 72 h post-infection. Virus titers in the cell lysates were determined by plaque assay and fold increase in the virus titer relative to input virus was plotted.
Figure 52:
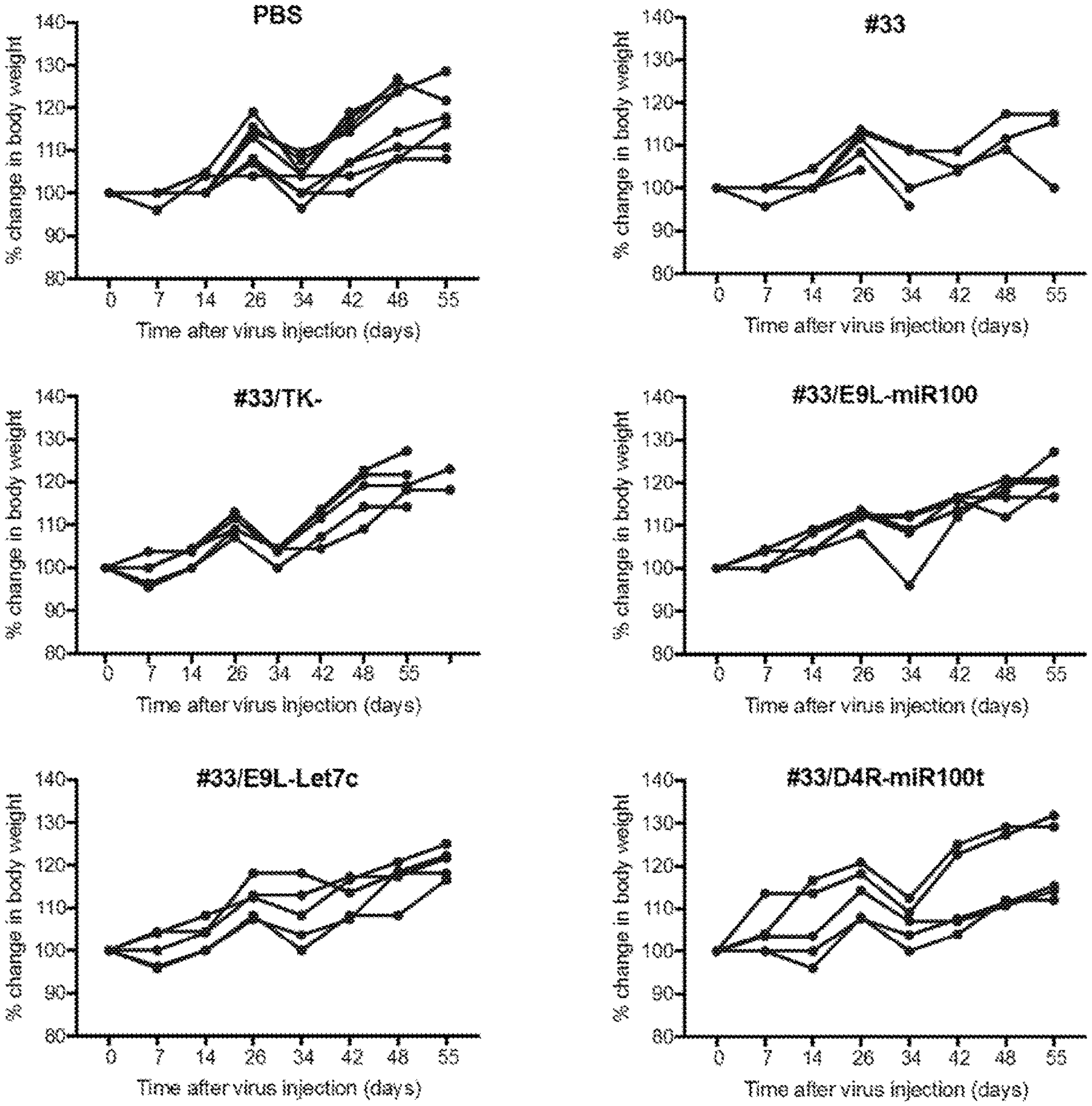
FIG. 52. Percent change in weight of mice. OVCAR8, human ovarian cancer cells, were cultured, trypsinized, washed with PBS and resuspended in 1:1 PBS and matrigel to get $5\times10^6$ cells per 100 μL. 100 μL of the cell suspension was injected sub-cutaneously on each side of upper flank of athymic nude mice to generate 2 tumors per mouse. 3 weeks post-tumor cell injections, the mice were sorted into different treatment groups (n=8 for PBS and n=5 for all other groups) so as to obtain similar average tumor volume in each group (~200 $mm^3$). After sorting, only the right-side tumor in each mouse was injected with $10^5$ PFUs of the indicated viruses or PBS intra-tumorally. Mice were weighed twice weekly and percent change in their weight was plotted. Each line represents weight of individual mouse.
Figure 52:
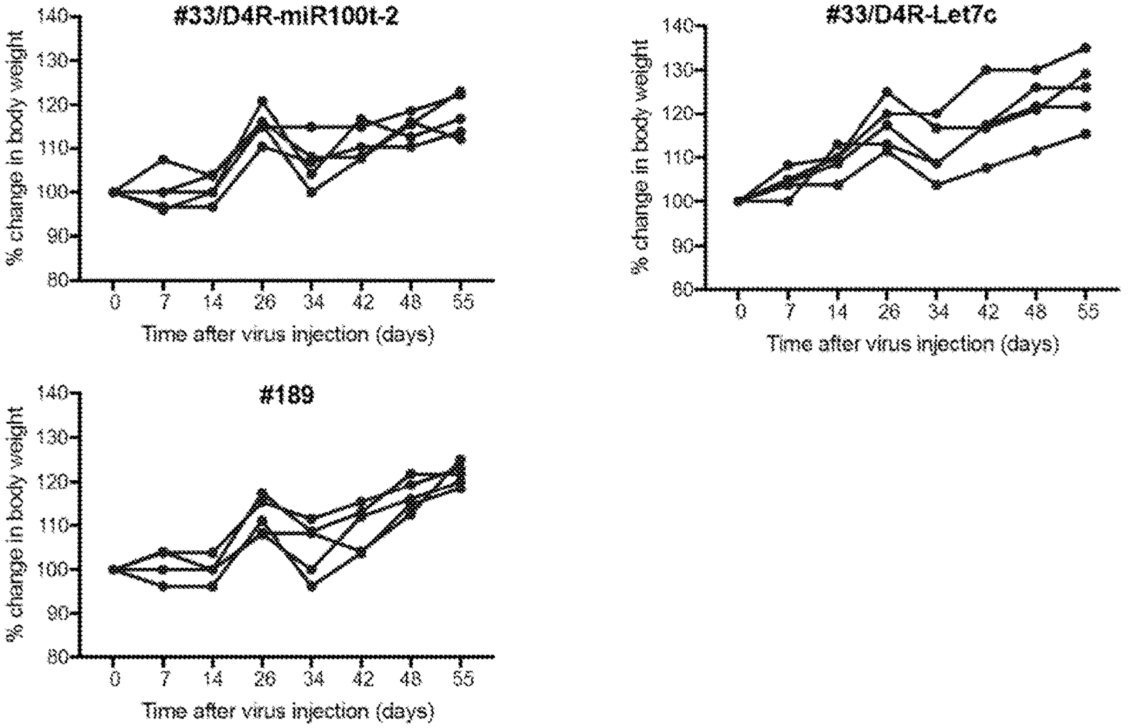
Figure 53:
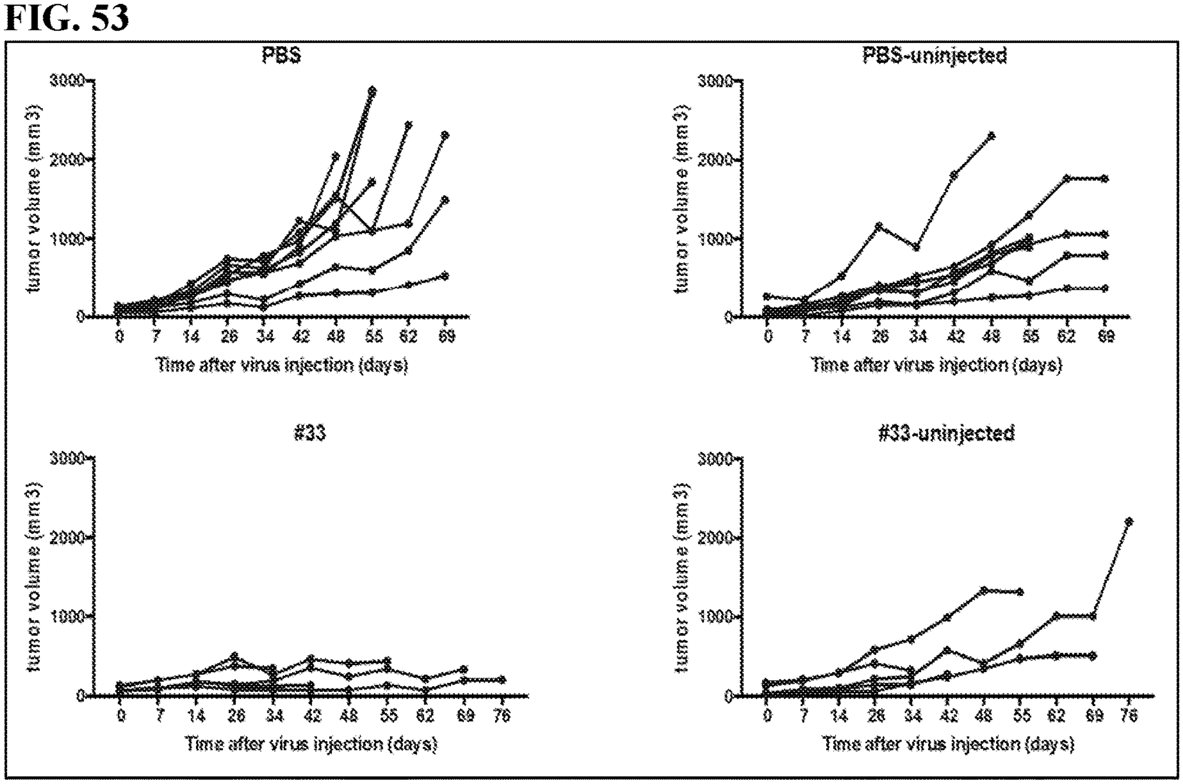
FIG. 53. Tumor volume. OVCAR8, human ovarian cancer cells, were cultured, trypsinized, washed with PBS and resuspended in 1:1 PBS and matrigel to get $5\times10^6$ cells per 100 μL. 100 μL of the cell suspension was injected sub-cutaneously on each side of upper flank of athymic nude mice to generate 2 tumors per mouse. 3 weeks post-tumor cell injections, the mice were sorted into different treatment groups (n=8 for PBS and n=5 for all other groups) so as to obtain similar average tumor volume in each group (~200 $mm^3$). After sorting, only the right-side tumor in each mouse was injected with $10^5$ PFUs of the indicated viruses or PBS intra-tumorally. Volume of tumors were measured twice weekly using digital calipers (volume={(length)$^2$×breadth/2}. Volume of virus injected and un-injected tumors for individual mouse in each treatment group has been plotted.
Figure 53:
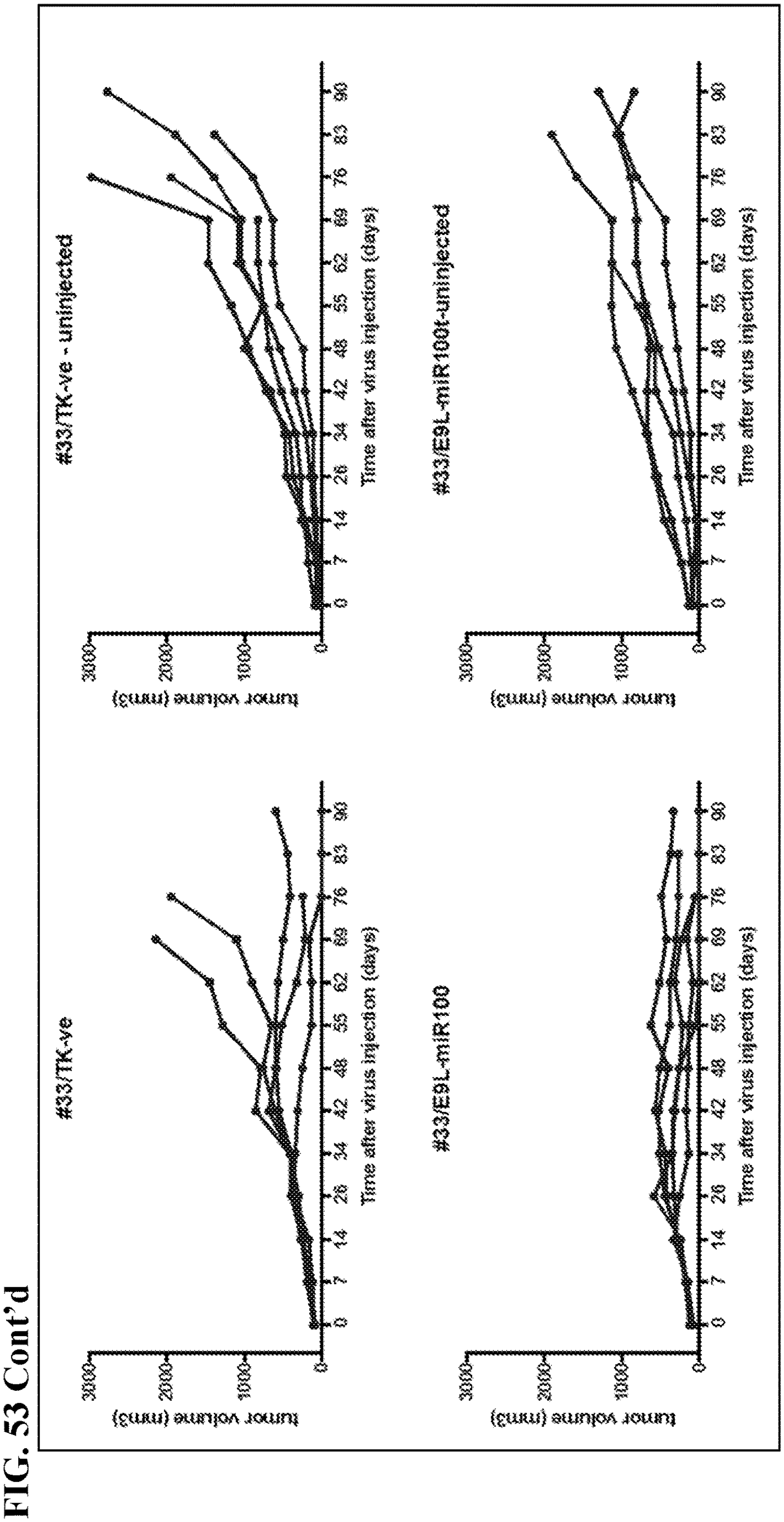
Figure 53:
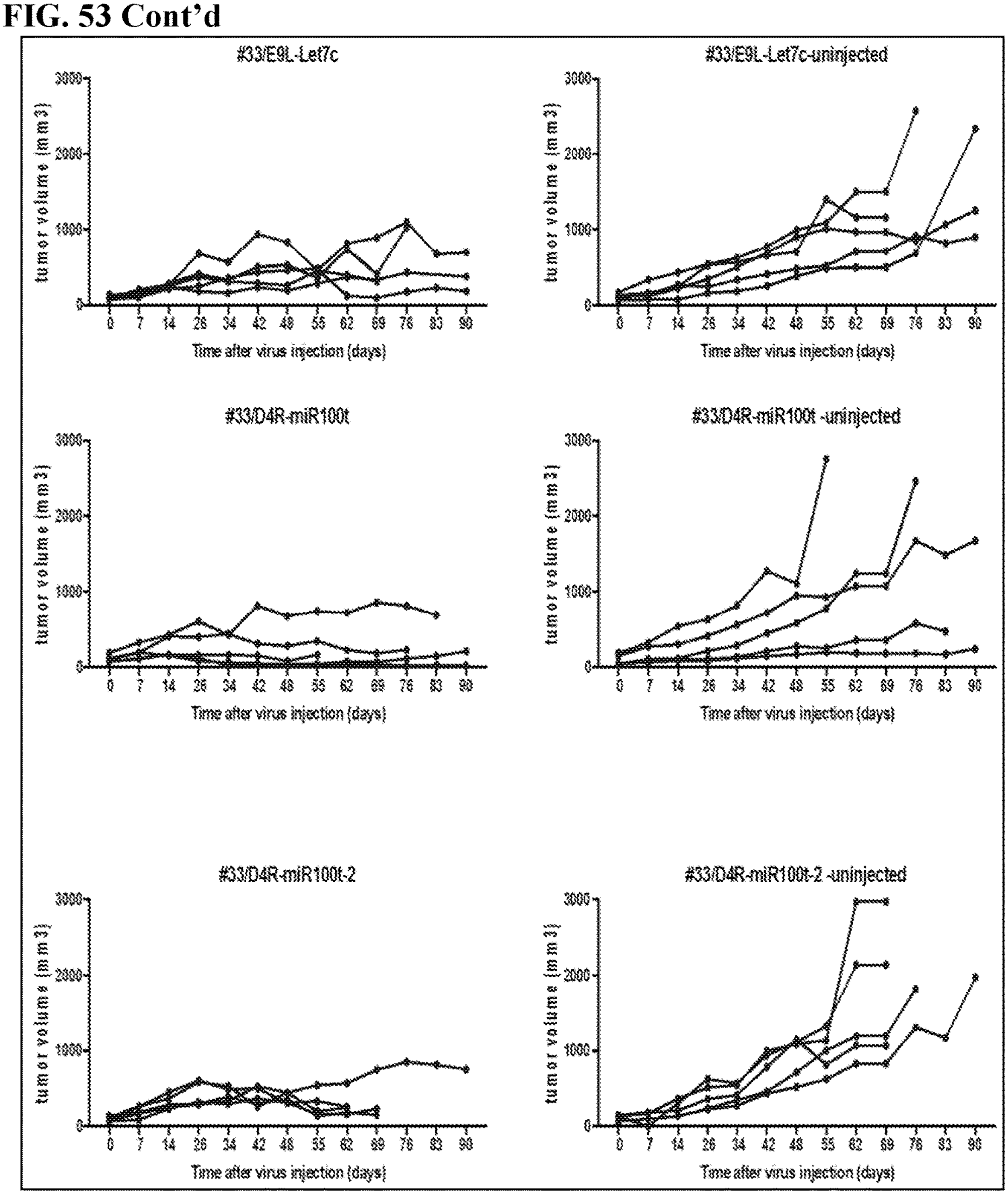
Figure 53:
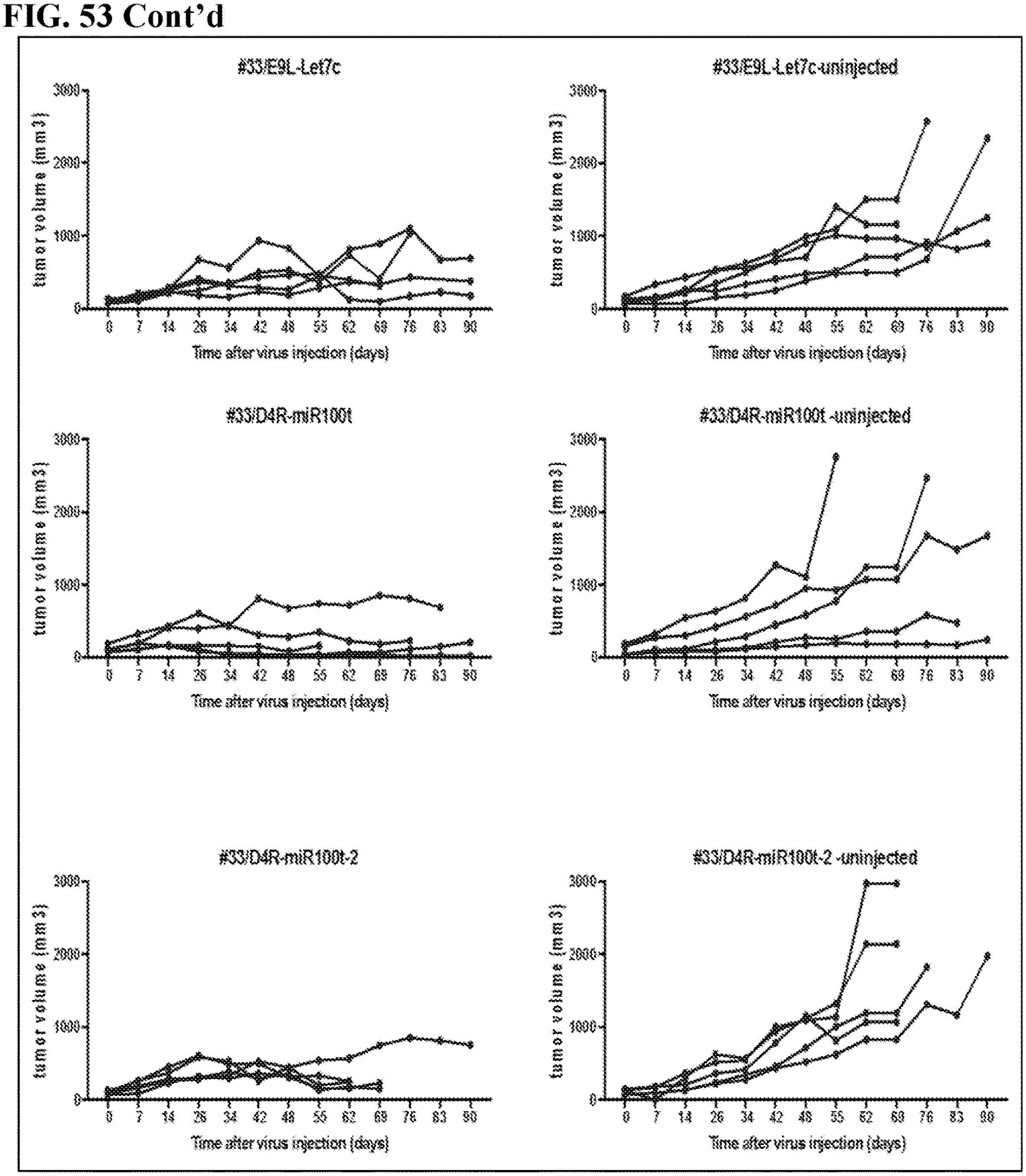
Figure 53:
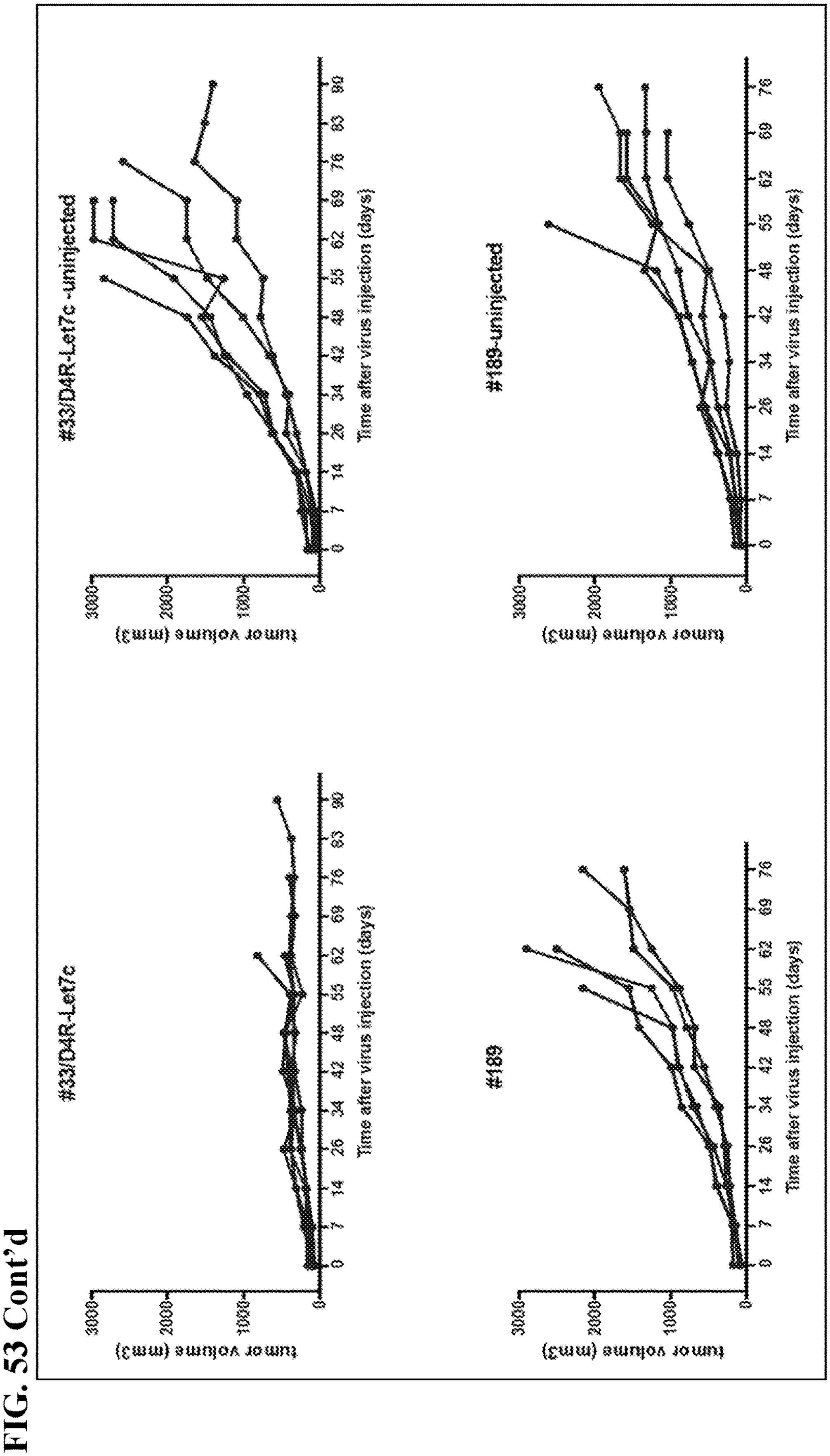
Figure 54A:
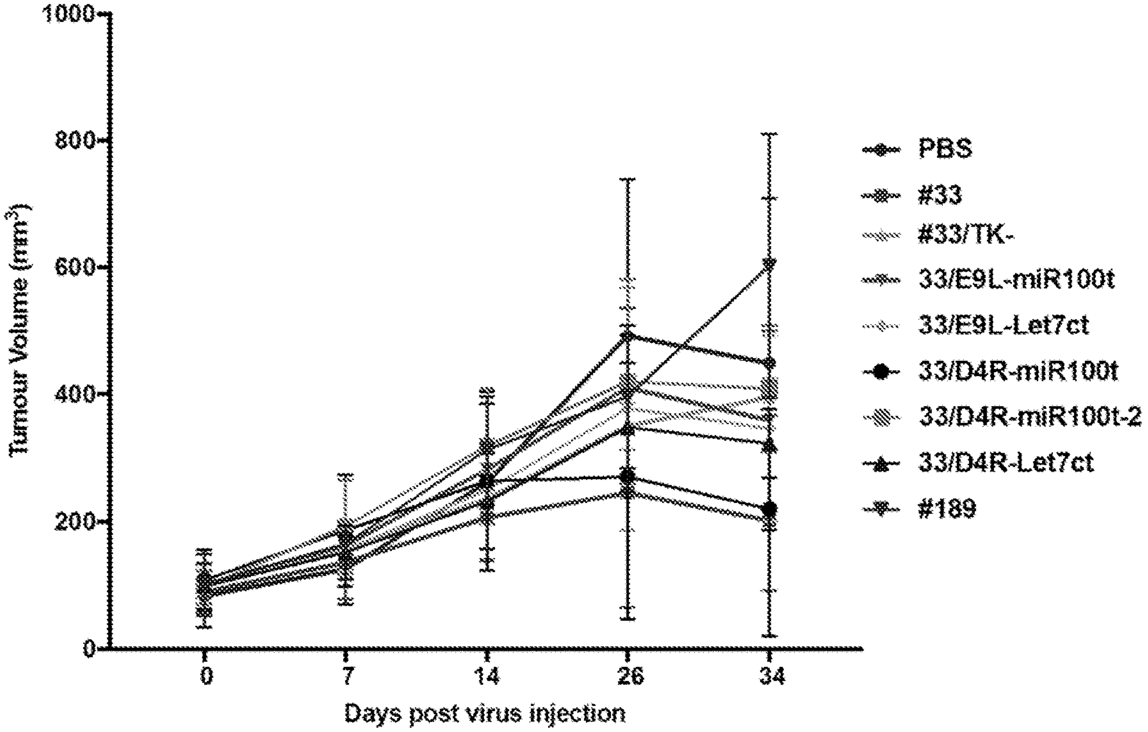
FIGS. 54A-54B. Average tumor volume for injected and un-injected tumors. OVCAR8, human ovarian cancer cells, were cultured, trypsinized, washed with PBS and resuspended in 1:1 PBS and matrigel to get $5\times10^6$ cells per 100 μL. 100 μL of the cell suspension was injected sub-cutaneously on each side of upper flank of athymic nude mice to generate 2 tumors per mouse. 3 weeks post-tumor cell injections, the mice were sorted into different treatment groups (n=8 for PBS and n=5 for all other groups) so as to obtain similar average tumor volume in each group (~200 $mm^3$). After sorting, only the right-side tumor in each mouse was injected with $10^5$ PFUs of the indicated viruses or PBS intra-tumorally. Volume of tumors were measured twice weekly using digital caliper (voulme={(length)$^2$×breadth/2}. Average tumor volume with SD for each treatment group has been plotted.
Figure 54B:
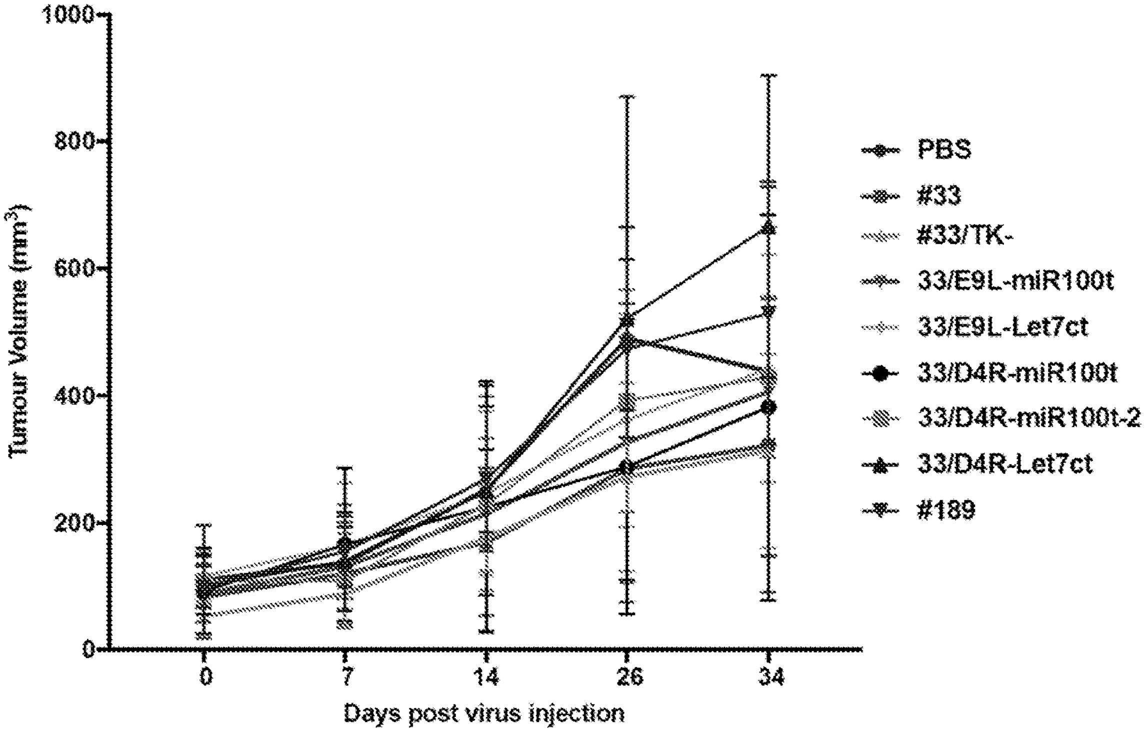
Figure 55:
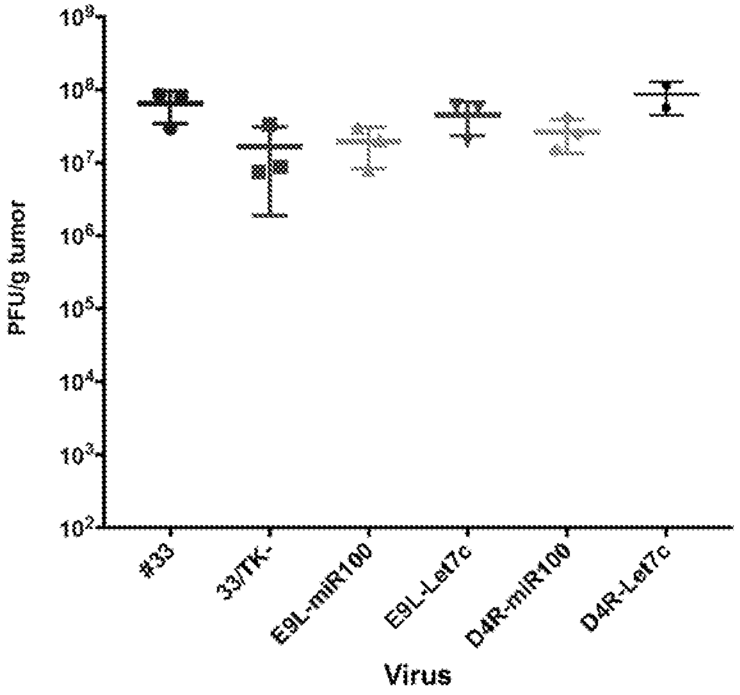
FIG. 55. Virus titers in organs 7 days post-infection. OVCAR8, human ovarian cancer cells, were cultured, trysinized, washed with PBS and resuspended in 1:1 PBS and matrigel to get a $5\times10^6$ cells per 100 μL. 100 μL of the cell suspension was injected sub-cutaneously on each side of upper flank of athymic nude mice to generate 2 tumors per mouse. 3 weeks post-tumor cell injections, the mice were sorted into different treatment groups (n=3) so as to obtain similar average tumor volume in each group (~200 $mm^3$). After sorting, only the right-side tumor in each mouse was injected $10^5$ PFUs of the indicated viruses, intra-tumorally. At day 7 after virus injection mice were euthanised and their organs as well as tumors were harvested. Virus titers in the harvested organs were determined by plaque assay and compared among the tumors and organs. Note: No virus detected in normal organs (lungs, liver, ovary, kidney, spleen and brain) and un-injected tumors.
Figure 56:
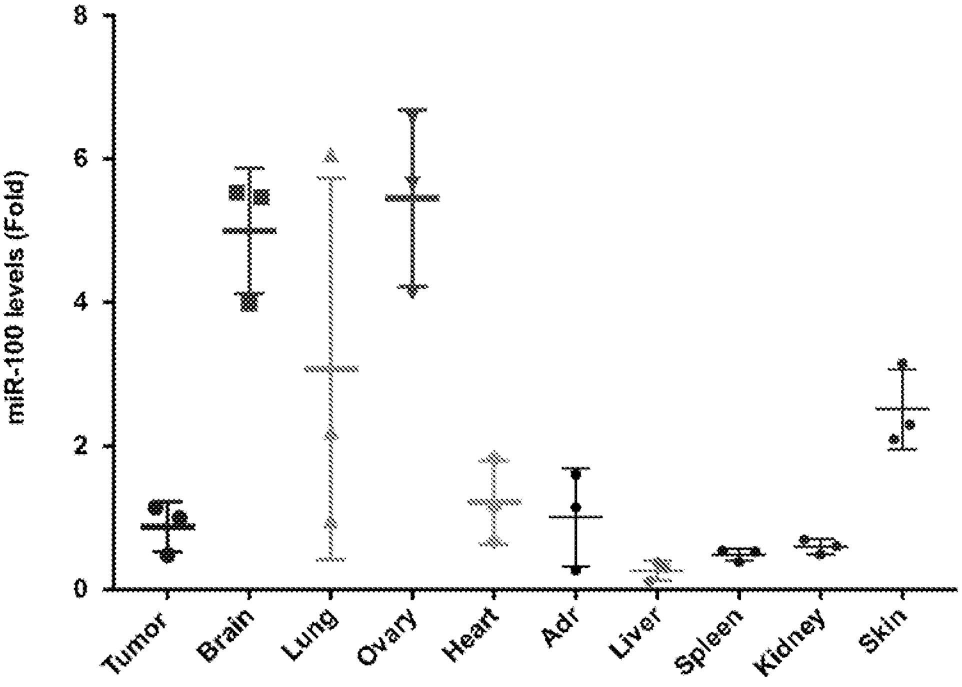
FIG. 56. miR100 in OVCAR8 tumors and mouse organs. Athymic nude mice bearing OVCAR8 xenografts (n=3) were euthanised and their organs as well as tumors were harvested. Harvested tissues were homogenised and total RNA was isolated using miRNeasy mini kit (Qiagen). Real-time per was performed to determine the levels of miR-100 in the lysates.
Figure 57:
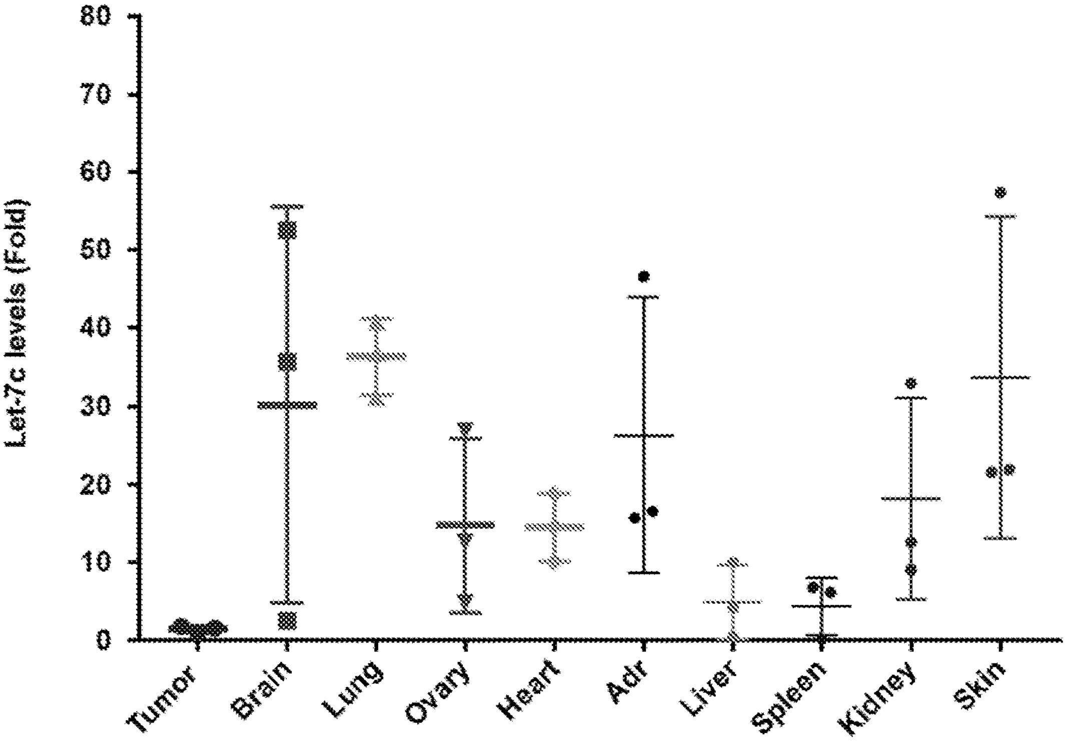
FIG. 57. Let-7c in OVCAR8 tumors and mouse organs. Athymic nude mice bearing OVCAR8 xenografts (n=3) were euthanised and their organs as well as tumors were harvested. Harvested tissues were homogenised and total RNA was isolated using miRNeasy mini kit (Qiagen). Real-time per was performed to determine the levels of Let-7c in the lysates.

Virus titer in blood 20 days post-virus injection. A549, human lung cancer cells, were cultured, trysinized, washed with PBS and resuspended in 1:1 PBS and matrigel to get $5\times10^6$ cells per 100 μL. 100 μL of the cell suspension was injected subcutaneously on each side of upper flank of athymic nude mice to generate 2 tumors per mouse. 3 weeks post-tumor cell injections, the mice were sorted into different treatment groups (n=3) so as to obtain similar average tumor volume in each group (~200 $mm^3$). After sorting, only the right-side tumor in each mouse was injected with $10^3$ PFUs of the indicated viruses (#33, #33-(H5)Emerald, GLV-1h68, OncoVEX$^{GFP}$, T-VEC) intra-tumorally. Blood was collected from mice (n=3) through facial vein puncture. After 3 freeze-thaw cycles, blood was serially diluted and virus titer was determined using standard plaque assay (FIG. 37). **ND means the virus was not detected.

REFERENCES

1. Chen N G & Szalay A A (2011) Oncolytic virotherapy of cancer. *Cancer Management in Man: Chemotherapy, Biological Therapy, Hyperthermia and Supporting Measures*, Cancer Growth and Progression, ed Minev B R (Springer, New York), Vol 13, pp 295-316.
2. Chen N G & Szalay A A (2010) Oncolytic vaccinia virus: a theranostic agent for cancer. *Future Virol.* 5(6):763-784.
3. Andtbacka R H, et al. (2015) Talimogene Laherparepvec Improves Durable Response Rate in Patients With Advanced Melanoma. *J Clin Oncol* 33(25):2780-2788.
4. Anonymous (2015) First Oncolytic Viral Therapy for Melanoma. *Cancer discovery.*
5. Russell S J, Peng K W, & Bell J C (2012) Oncolytic virotherapy. *Nat Biotechnol* 30(7):658-670.
6. Thorne S H, et al. (2007) Rational strain selection and engineering creates a broad-spectrum, systemically effective oncolytic poxvirus, JX-963. *J Clin Invest* 117(11): 3350-3358.
7. Yu W & Fang H (2007) Clinical trials with oncolytic adenovirus in China. *Curr Cancer Drug Targets* 7(2): 141-148.
8. Evgin L, et al. (2010) Potent Oncolytic Activity of Raccoonpox Virus in the Absence of Natural Pathogenicity. *Mol Ther.*
9. Rintoul J L, et al. (2012) ORFV: a novel oncolytic and immune stimulating parapoxvirus therapeutic. *Mol Ther* 20(6):1148-1157.
10. Chan W M & McFadden G (2014) Oncolytic Poxviruses. *Annu Rev Virol* 1(1):119-141.
11. Wahba, H. A. and H. A. El-Hadaad, *Current approaches in treatment of triple-negative breast cancer*. Cancer Biol Med, 2015. 12(2): p. 106-16.
12. Curigliano, G. and A. Goldhirsch, *The triple-negative subtype: new ideas for the poorest prognosis breast cancer*. J Natl Cancer Inst Monogr, 2011. 2011(43): p. 108-10.
13. Bianchini, G., et al., *Triple-negative breast cancer: challenges and opportunities of a heterogeneous disease*. Nat Rev Clin Oncol, 2016. 13(11): p. 674-690.
14. Migali, C., et al., *Strategies to modulate the immune system in breast cancer: checkpoint inhibitors and beyond*. Ther Adv Med Oncol, 2016. 8(5): p. 360-74.
15. Gholami, S., et al., *A novel vaccinia virus with dual oncolytic and anti-angiogenic therapeutic effects against triple-negative breast cancer*. Breast Cancer Res Treat, 2014. 148(3): p. 489-99.
16. Dent, R., et al., *Pattern of metastatic spread in triple-negative breast cancer*. Breast Cancer Res Treat, 2009. 115(2): p. 423-8.
17. Liedtke, C., et al., *Response to neoadjuvant therapy and long-term survival in patients with triple-negative breast cancer*. J Clin Oncol, 2008. 26(8): p. 1275-81.
18. Andtbacka, R. C., M; Li, A; Shilkrut, M; Ross, M I, Phase 2, multicenter, randomized, open-label trial assessing efficacy and safety of talimogene laherparepvec (T-VEC) neoadjuvant treatment plus surgery vs surgery for resectable stage IIIB/C and IVM1a melanoma. J Clin Oncol, 2015. 33: TPS9094.
19. Anderson, B. D., et al., High CD46 receptor density determines preferential killing of tumor cells by oncolytic measles virus. Cancer Res, 2004. 64(14): p. 4919-26.
20. Kaufman, H. L., F. J. Kohlhapp, and A. Zloza, Oncolytic viruses: a new class of immunotherapy drugs. Nat Rev Drug Discov, 2015. 14(9): p. 642-62.
21. Wang, G., et al., Infection of human cancer cells with myxoma virus requires Akt activation via interaction with a viral ankyrin-repeat host range factor. Proc Natl Acad Sci USA, 2006. 103(12): p. 4640-5.
22. Benencia, F., et al., HSV oncolytic therapy upregulates interferon-inducible chemokines and recruits immune effector cells in ovarian cancer. Mol Ther, 2005. 12(5): p. 789-802.
23. Gauvrit, A., et al., Measles virus induces oncolysis of mesothelioma cells and allows dendritic cells to cross-prime tumor-specific CD8 response. Cancer Res, 2008. 68(12): p. 4882-92.
24. Guillerme, J. B., et al., Measles virus vaccine-infected tumor cells induce tumor antigen cross-presentation by human plasmacytoid dendritic cells. Clin Cancer Res, 2013. 19(5): p. 1147-58.
25. Haen, S. P. and H. G. Rammensee, The repertoire of human tumor-associated epitopes—identification and selection of antigens and their application in clinical trials. Curr Opin Immunol, 2013. 25(2): p. 277-83.
26. Tang, D., et al., PAMPs and DAMPS: signal 0s that spur autophagy and immunity. Immunol Rev, 2012. 249(1): p. 158-75.
27. Fiebig, H. H., et al., Inactivated orf virus (Parapoxvirus ovis) induces antitumoral activity in transplantable tumor models. Anticancer Res, 2011. 31(12): p. 4185-90.
28. Rintoul, J. L., et al., ORFV: a novel oncolytic and immune stimulating parapoxvirus therapeutic. Mol Ther, 2012. 20(6): p. 1148-57.
29. Robinson, A. J. and G. V. Petersen, Orf virus infection of workers in the meat industry. N Z Med J, 1983. 96(725): p. 81-5.
30. Fachinger, V., et al., Poxvirus-induced immunostimulating effects on porcine leukocytes. J Virol, 2000. 74(17): p. 7943-51.
31. Friebe, A., et al., Characterization of immunostimulatory components of orf virus (parapoxvirus ovis). J Gen Virol, 2011. 92(Pt 7): p. 1571-84.
32. Horton R M, Ho S N, Pullen J K, Hunt H D, Cai Z, Pease L R. Gene splicing by overlap extension. Methods in enzymology. 1993; 217:270-9. Epub 1993/01/01. PubMed PMID: 8474334.
33. Falkner F G, Moss B. Transient dominant selection of recombinant vaccinia viruses. J Virol. 1990; 64(6):3108-11. Epub 1990/06/01. PubMed PMID: 2159565.

P EMBODIMENTS

Embodiment P1. A chimeric poxvirus comprising a nucleic acid sequence having a sequence identity of at least 70% to SEQ ID NO:1 or SEQ ID NO:2, wherein said nucleic acid sequence comprises nucleic acid fragments from at least two poxvirus strains selected from the group consisting of cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS.

Embodiment P2. The chimeric poxvirus of embodiment P1, wherein said nucleic acid sequence has a sequence identity of at least 80%.

Embodiment P3. The chimeric poxvirus of embodiment P1 or P2, wherein said nucleic acid sequence has a sequence identity of at least 85%.

Embodiment P4. The chimeric poxvirus of one of embodiments P1-P3, wherein said nucleic acid sequence has a sequence identity of at least 90%.

Embodiment P5. The chimeric poxvirus of one of embodiments P1-P4, wherein said nucleic acid sequence has a sequence identity of at least 95%.

Embodiment P6. The chimeric poxvirus of one of embodiments P1-P5, wherein said nucleic acid sequence has a sequence identity of at least 98%.

Embodiment P7. The chimeric poxvirus of one of embodiments P1-P6, wherein said nucleic acid fragments are from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic and vaccinia virus strain AS.

Embodiment P8. The chimeric poxvirus of one of embodiments P1-P6, wherein said nucleic acid fragments are from orf virus strain NZ2 and pseudocowpox virus strain TJS.

Embodiment P9. The chimeric poxvirus of embodiment P1, wherein said chimeric poxvirus is formed by a method comprising: (i) infecting a cell with at least two poxvirus strains selected from the group consisting of cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS; and (ii) allowing said at least two poxvirus strains to replicate, thereby forming a chimeric poxvirus.

Embodiment P10. The chimeric poxvirus of embodiment P9, wherein said cell is infected with cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic and vaccinia virus strain AS.

Embodiment P11. The chimeric poxvirus of embodiment P9, wherein said cell is infected with orf virus strain NZ2 and pseudocowpox virus strain TJS.

Embodiment P12. The chimeric poxvirus of one of embodiments P1-P11, wherein said chimeric poxvirus is an oncolytic virus.

Embodiment P13. The chimeric poxvirus of one of embodiments P1-P12, wherein said poxvirus comprises a miRNA binding sequence.

Embodiment P14. The chimeric poxvirus of embodiment P13, wherein said miRNA binding sequence forms part of the DNA polymerase gene of said chimeric poxvirus.

Embodiment P15. An isolated nucleic acid encoding a chimeric poxvirus of one of embodiments P1-P14.

Embodiment P16. A pharmaceutical composition comprising a therapeutically effective amount of a chimeric poxvirus of one of embodiments P1-P14.

Embodiment P17. A method of treating cancer in a subject in need thereof, said method comprising administering to said subject a therapeutically effective amount of a chimeric poxvirus of one of embodiments P1-P14, thereby treating cancer in said subject.

Embodiment P18. The method of embodiment P17, wherein said cancer is breast cancer, colon cancer, kidney cancer, leukemia, lung cancer, melanoma, ovarian cancer, prostate cancer, pancreatic cancer, brain cancer, liver cancer, gastric cancer or a sarcoma.

Embodiment P19. The method of embodiment P17 or P18, wherein said administering comprises administering a first chimeric poxvirus and a second chimeric poxvirus.

Embodiment P20. The method of embodiment P19, wherein said first chimeric poxvirus comprises a nucleic acid sequence having a sequence identity of at least 70% to SEQ ID NO:1 and wherein said nucleic acid sequence comprises nucleic acid fragments from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic and vaccinia virus strain AS.

Embodiment P21. The method of embodiment P19 or P20, wherein said second chimeric poxvirus comprises a nucleic acid sequence having a sequence identity of at least 70% to SEQ ID NO:2 and wherein said nucleic acid sequence comprises nucleic acid fragments from orf virus strain NZ2 and pseudocowpox virus strain TJS.

Embodiment P22. The method of one of embodiments P19-P21, wherein said first chimeric poxvirus and said second chimeric poxvirus are administered at a combined synergistic amount.

Embodiment P23. The method of one of embodiments P19-P22, wherein said first chimeric poxvirus and said second chimeric poxvirus are administered simultaneously.

Embodiment P24. The method of one of embodiments P19-P22, wherein said first chimeric poxvirus and said second chimeric poxvirus are administered sequentially.

Embodiment P25. The method of one of embodiments P19-P24, wherein said poxvirus is administered at least $10^4$ plaque forming units (Pfu)/kg.

Embodiment P26. The method of one of embodiments P19-P25, wherein said poxvirus is administered at least $10^6$ plaque forming units (Pfu)/kg.

Embodiment P27. The method of one of embodiments P19-P26, wherein said poxvirus is administered at about $10^8$ plaque forming units (Pfu)/kg.

Embodiment P28. A method of forming a chimeric poxvirus, said method comprising: (i) infecting a cell with at least two poxvirus strains selected from the group consisting of cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS; and (ii) allowing said at least two poxvirus strains to replicate, thereby forming said chimeric poxvirus.

Embodiment P29. The method of embodiment P28, wherein said at least two poxvirus strains are each present at a multiplicity of infection of less than about 1.

Embodiment P30. The method of embodiment P28 or P29, wherein said at least two poxvirus strains are each present at a multiplicity of infection of less than about 0.1.

Embodiment P31. The method of one of embodiments P28-P30, wherein said at least two poxvirus strains are each present at a multiplicity of infection of about 0.01.

Embodiment P32. The method of embodiment P28, wherein said cell is infected with cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic and vaccinia virus strain AS.

Embodiment P33. The method of embodiment P28, wherein said cell is infected with orf virus strain NZ2 and pseudocowpox virus strain TJS.

Embodiment P34. The method of one of embodiments P28-P33, wherein said chimeric poxvirus is an oncolytic virus.

Embodiment P35. The method of one of embodiments P28-P34, wherein said poxvirus comprises a miRNA binding sequence.

Embodiment P36. A method of inhibiting cell proliferation of a cell, said method comprising contacting a cell with a chimeric poxvirus of one of embodiments P1-P14.

Embodiment P37. The method of embodiment P36, wherein said cell is a cancer cell.

Embodiment P38. The method of embodiment P37, wherein said cancer cell is a breast cancer cell, a colon cancer cell, a kidney cancer cell, a leukemia cell, a lung cancer cell, a melanoma cell, an ovarian cancer cell, a prostate cancer cell, a pancreatic cancer cell, a brain cancer cell, a liver cancer cell, a gastric cancer cell or a sarcoma cell.

EMBODIMENTS

Embodiment 1. A chimeric poxvirus comprising a nucleic acid sequence having a sequence identity of at least 70% to SEQ ID NO:1 or SEQ ID NO:2, wherein said nucleic acid sequence comprises: (i) nucleic acid fragments from at least two poxvirus strains selected from the group consisting of cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS; (ii) one or more anti-cancer nucleic acid sequences; or (iii) a detectable moiety-encoding nucleic acid sequence.

Embodiment 2. The chimeric poxvirus of embodiment 1, wherein said nucleic acid sequence comprises: (i) nucleic acid fragments from at least two poxvirus strains selected from the group consisting of cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS; and (ii) one or more anti-cancer nucleic acid sequences.

Embodiment 3. The chimeric poxvirus of embodiment 1 or 2, wherein said one or more anti-cancer nucleic acid sequences form part of a non-essential gene of said chimeric poxvirus.

Embodiment 4. The chimeric poxvirus of embodiment 3, wherein said non-essential gene is a thymidine kinase gene.

Embodiment 5. The chimeric poxvirus of embodiment 3, wherein said non-essential gene is a F14.5L gene.

Embodiment 6. The chimeric poxvirus of one of embodiments 1-5, wherein said one or more anti-cancer nucleic acid sequences independently encode a PD-L1 inhibitor or a sodium iodide symporter.

Embodiment 7. The chimeric poxvirus of embodiment 6, wherein said PD-L1 inhibitor is an anti-PD-L1 scFv.

Embodiment 8. The chimeric poxvirus of one of embodiments 1-7, wherein parts of said non-essential gene are deleted.

Embodiment 9. The chimeric poxvirus of one of embodiments 1-8, wherein said one or more anti-cancer nucleic acid sequences are each operably linked to a promoter.

Embodiment 10. The chimeric poxvirus of embodiment 9, wherein said promoter is a vaccinia virus early promoter.

Embodiment 11. The chimeric poxvirus of embodiment 9 or 10, wherein said promoter is a synthetic early promoter.

Embodiment 12. The chimeric poxvirus of embodiment 9, wherein said promoter is a vaccinia virus late promoter.

Embodiment 13. The chimeric poxvirus of embodiment 9 or 12, wherein said promoter is a H5 promoter or an 11K promoter.

Embodiment 14. The chimeric poxvirus of one of embodiments 1-8, wherein said one or more anti-cancer nucleic acid sequences are operably linked to an essential gene of said chimeric poxvirus.

Embodiment 15. The chimeric poxvirus of one of embodiments 1-14, wherein said one or more anti-cancer nucleic acid sequences are operably linked to a DNA polymerase gene of said chimeric poxvirus.

Embodiment 16. The chimeric poxvirus of one of embodiments 1-15, wherein said one or more anti-cancer nucleic acid sequences are operably linked to the 3' end of a DNA polymerase gene of said chimeric poxvirus.

Embodiment 17. The chimeric poxvirus of one of embodiments 1-16, wherein said one or more anti-cancer nucleic acid sequences are operably linked to a uracil DNA glycosylase gene.

Embodiment 18. The chimeric poxvirus of one of embodiments 1-17, wherein said one or more anti-cancer nucleic acid sequences are operably linked to the 3'end of a uracil DNA glycosylase gene.

Embodiment 19. The chimeric poxvirus of one of embodiments 1-18, wherein said one or more anti-cancer nucleic acid sequences independently encode for a miRNA binding sequence.

Embodiment 20. The chimeric poxvirus of embodiment 19, wherein said miRNA binding sequence is a miR100 binding sequence or a let7c binding sequence.

Embodiment 21. The chimeric poxvirus of one of embodiments 1-20, wherein said one or more anti-cancer nucleic acid sequences are a first anti-cancer nucleic acid sequence and a second anti-cancer nucleic acid sequence.

Embodiment 22. The chimeric poxvirus of embodiment 21, wherein said first anti-cancer nucleic acid sequence encodes a sodium iodide symporter and said second anti-cancer nucleic acid sequence encodes a miRNA binding sequence.

Embodiment 23. The chimeric poxvirus of embodiment 22, wherein said first anti-cancer nucleic acid sequence forms part of a thymidine kinase gene and said second anti-cancer nucleic acid sequence is operably linked to a uracil DNA glycosylase gene.

Embodiment 24. The chimeric poxvirus of embodiment 22, wherein said first anti-cancer nucleic acid sequence forms part of a thymidine kinase gene and said second anti-cancer nucleic acid sequence is operably linked to a DNA polymerase gene.

Embodiment 25. The chimeric poxvirus of embodiment 21, wherein said first anti-cancer nucleic acid sequence encodes a sodium iodide symporter and said second anti-cancer nucleic acid sequence encodes a PD-L1 inhibitor.

Embodiment 26. The chimeric poxvirus of embodiment 25, wherein said first anti-cancer nucleic acid sequence forms part of a thymidine kinase gene and said second anti-cancer nucleic acid sequence forms part of a F14.5L gene.

Embodiment 27. The chimeric poxvirus of embodiment 1, wherein said nucleic acid sequence comprises: (i) nucleic acid fragments from at least two poxvirus strains selected from the group consisting of cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS; and (ii) said detectable moiety-encoding nucleic acid sequence.

Embodiment 28. The chimeric poxvirus of embodiment 27, wherein said detectable moiety-encoding nucleic acid sequence encodes a fluorescent moiety.

Embodiment 29. The chimeric poxvirus of embodiment 27 or 28, wherein said detectable moiety-encoding nucleic acid sequence forms part of a non-essential gene of said chimeric poxvirus.

Embodiment 30. The chimeric poxvirus of embodiment 29, wherein said non-essential gene is a thymidine kinase gene.

Embodiment 31. The chimeric poxvirus of embodiment 29 or 30, wherein parts of said non-essential gene are deleted.

Embodiment 32. The chimeric poxvirus of one of embodiments 27-31, wherein said detectable moiety-encoding nucleic acid sequence is operably linked to a promoter.

Embodiment 33. The chimeric poxvirus of embodiment 32, wherein said promoter is a vaccinia virus early promoter.

Embodiment 34. The chimeric poxvirus of embodiment 33, wherein said promoter is a synthetic early promoter.

Embodiment 35. The chimeric poxvirus of embodiment 32, wherein said promoter is a vaccinia virus late promoter.

Embodiment 36. The chimeric poxvirus of embodiment 35, wherein said promoter is a H5 promoter or an 11K promoter.

Embodiment 37. The chimeric poxvirus of one of embodiments 1-36, wherein said nucleic acid sequence has a sequence identity of at least 80%.

Embodiment 38. The chimeric poxvirus of one of embodiments 1-37, wherein said nucleic acid sequence has a sequence identity of at least 85%.

Embodiment 39. The chimeric poxvirus of one of embodiments 1-38, wherein said nucleic acid sequence has a sequence identity of at least 90%.

Embodiment 40. The chimeric poxvirus of one of embodiments 1-39, wherein said nucleic acid sequence has a sequence identity of at least 95%.

Embodiment 41. The chimeric poxvirus of one of embodiments 1-40, wherein said nucleic acid sequence has a sequence identity of at least 98%.

Embodiment 42. The chimeric poxvirus of one of embodiments 1-41, wherein said nucleic acid fragments are from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic and vaccinia virus strain AS.

Embodiment 43. The chimeric poxvirus of one of embodiments 1-41, wherein said nucleic acid fragments are from orf virus strain NZ2 and pseudocowpox virus strain TJS.

Embodiment 44. The chimeric poxvirus of one of embodiments 1-43, wherein said chimeric poxvirus is formed by a method comprising: (i) infecting a cell with at least two poxvirus strains selected from the group consisting of cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS; and (ii) allowing said at least two poxvirus strains to replicate, thereby forming a chimeric poxvirus.

Embodiment 45. The chimeric poxvirus of embodiment 44, wherein said cell is infected with cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic and vaccinia virus strain AS.

Embodiment 46. The chimeric poxvirus of embodiment 44, wherein said cell is infected with orf virus strain NZ2 and pseudocowpox virus strain TJS.

Embodiment 47. The chimeric poxvirus of one of embodiments 1-46, wherein said chimeric poxvirus is an oncolytic virus.

Embodiment 48. The chimeric poxvirus of one of embodiments 1-47, wherein said poxvirus comprises a miRNA binding sequence.

Embodiment 49. The chimeric poxvirus of embodiment 48, wherein said miRNA binding sequence forms part of the DNA polymerase gene of said chimeric poxvirus.

Embodiment 50. An isolated nucleic acid encoding a chimeric poxvirus of one of embodiments 1-49.

Embodiment 51. A pharmaceutical composition comprising a therapeutically effective amount of a chimeric poxvirus of one of embodiments 1-49.

Embodiment 52. A method of treating cancer in a subject in need thereof, said method comprising administering to said subject a therapeutically effective amount of a chimeric poxvirus of one of embodiments 1-49, thereby treating cancer in said subject.

Embodiment 53. The method of embodiment 52, wherein said cancer is breast cancer, colon cancer, kidney cancer, leukemia, lung cancer, melanoma, ovarian cancer, prostate cancer, pancreatic cancer, brain cancer, liver cancer, gastric cancer or a sarcoma.

Embodiment 54. The method of embodiment 52 or 53, wherein said cancer is triple-negative breast cancer.

Embodiment 55. The method of one of embodiments 52-54, wherein said administering comprises administering a first chimeric poxvirus and a second chimeric poxvirus.

Embodiment 56. The method of embodiment 55, wherein said first chimeric poxvirus comprises a nucleic acid sequence having a sequence identity of at least 70% to SEQ ID NO:1 and wherein said nucleic acid sequence comprises nucleic acid fragments from cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic and vaccinia virus strain AS.

Embodiment 57. The method of embodiment 55 or 56, wherein said second chimeric poxvirus comprises a nucleic acid sequence having a sequence identity of at least 70% to SEQ ID NO:2 and wherein said nucleic acid sequence comprises nucleic acid fragments from orf virus strain NZ2 and pseudocowpox virus strain TJS.

Embodiment 58. The method of one of embodiments 55-57, wherein said first chimeric poxvirus and said second chimeric poxvirus are administered at a combined synergistic amount.

Embodiment 59. The method of one of embodiments 55-58, wherein said first chimeric poxvirus and said second chimeric poxvirus are administered simultaneously.

Embodiment 60. The method of one of embodiments 55-58, wherein said first chimeric poxvirus and said second chimeric poxvirus are administered sequentially.

Embodiment 61. The method of one of embodiments 52-60, wherein said poxvirus is administered with at least $10^3$ plaque forming units (Pfu)/kg.

Embodiment 62. The method of one of embodiments 52-61, wherein said poxvirus is administered at about $10^3$ plaque forming units (Pfu)/kg.

Embodiment 63. The method of one of embodiments 52-61, wherein said poxvirus is administered with at least $10^4$ plaque forming units (Pfu)/kg.

Embodiment 64. The method of one of embodiments 52-61, wherein said poxvirus is administered at about $4\times10^4$ plaque forming units (Pfu)/kg.

Embodiment 65. The method of one of embodiments 52-61, wherein said poxvirus is administered at about $5\times10^4$ plaque forming units (Pfu)/kg.

Embodiment 66. The method of one of embodiments 52-61, wherein said poxvirus is administered with at least $10^6$ plaque forming units (Pfu)/kg.

Embodiment 67. The method of one of embodiments 52-61, wherein said poxvirus is administered at about $10^8$ plaque forming units (Pfu)/kg.

Embodiment 68. A method of forming a chimeric poxvirus, said method comprising: (i) infecting a cell with at least two poxvirus strains selected from the group consisting of cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, vaccinia virus strain AS, orf virus strain NZ2 and pseudocowpox virus strain TJS; and (ii) allowing said at least two poxvirus strains to replicate, thereby forming said chimeric poxvirus.

Embodiment 69. The method of embodiment 68, wherein said at least two poxvirus strains are each present at a multiplicity of infection of less than about 1.

Embodiment 70. The method of embodiment 68 or 69, wherein said at least two poxvirus strains are each present at a multiplicity of infection of less than about 0.1.

Embodiment 71. The method of one of embodiments 68-70, wherein said at least two poxvirus strains are each present at a multiplicity of infection of about 0.01.

Embodiment 72. The method of embodiment 68, wherein said cell is infected with cowpox virus strain Brighton, raccoonpox virus strain Herman, rabbitpox virus strain Utrecht, vaccinia virus strain WR, vaccinia virus strain IHD, vaccinia virus strain Elstree, vaccinia virus strain CL, vaccinia virus strain Lederle-Chorioallantoic and vaccinia virus strain AS.

Embodiment 73. The method of embodiment 68, wherein said cell is infected with orf virus strain NZ2 and pseudocowpox virus strain TJS.

Embodiment 74. The method of one of embodiments 68-73, wherein said chimeric poxvirus is an oncolytic virus.

Embodiment 75. The method of one of embodiments 68-74, wherein said poxvirus comprises a miRNA binding sequence.

Embodiment 76. A method of inhibiting cell proliferation of a cell, said method comprising contacting a cell with a chimeric poxvirus of one of embodiments 1-49.

Embodiment 77. The method of embodiment 76, wherein said cell is a cancer cell.

Embodiment 78. The method of embodiment 77, wherein said cancer cell is a breast cancer cell, a colon cancer cell, a kidney cancer cell, a leukemia cell, a lung cancer cell, a melanoma cell, an ovarian cancer cell, a prostate cancer cell, a pancreatic cancer cell, a brain cancer cell, a liver cancer cell, a gastric cancer cell or a sarcoma cell.

Embodiment 79. The method of embodiment 77 or 78, wherein said cancer cell is a triple-negative breast cancer cell.

---

SEQUENCE LISTING (54 sequences)

SEQ ID NO: 1 - DNA, 189415 bp, Artificial Sequence
  Synthetic Polynucleotide
gagaaagagataaaacttttttacgactccatcagaaagaggtttaatatttttgtgagaccatcgaagagagaaagagaaagagatagttagtctagatatttttcttagtacaaaagtcaatgttttaaaatatatggacaagaatttgtctgtataaaaacttgtgtgaaattttgtaccaaagaaaaaatgtgagcagtatcccctacatggattttactagatcatttatataccaaaaaatattatacgatctacgttttattatatgattttaacgtgtaaattataaacattattttatgatatacaattgtctggtaacctagatgggcataggggatgttgataagctcgacgagtatatgttgttggacgttattgtttaagaaatagttgatgcatcagaaagagaataaaaaatattttagtgagaccatcgaagagagaaagagataaaacttttttacgactccatcagaaagaggtttaatatttttgtgagaccatcgaagagagaaagagaataaaaatattttatgactccattgaagagagaaagagaaaatgagaatgagaataaaaatattttagtgacaccatcagaaagaggtttaatatttttgtgagaccatcgaagagagaaagagaataaaaatattttatgactccattgaagagagaaagagaaaatgagaatgagaataaaaatattttagtgacaccatcagaaagaggtttaatattttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaaaatatttttgtaaaactttttttatgagaccatcagaaagaggtttaatatttttgtgataccctgaaaggaaataggaataggaatagtgtcataatcgtatcacactattgagacagaaaaagaagaagtcgcgagaggtaactttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgacctcaagttcagatgattccttgcacatgtctccgatacgaacgctaaactctagattcttgacacattttgtatcgacgatcgttgaaccgatgatatcttcgtaactcactttcttatgagagatgttagacccgagtactggatgggtcttgatgtcgctgtctttctcttcttcgctacatctgatgtcgatagacacctcacagtctttccatcagcggattctgagatggatttaatctgaggacatttggtgaatccaaagttcattctcagacctccaccgatgatggagtaataagtggtaggaggatctacatcctcgactgattccacctcgggatctggatctgactcggactctgtaatttccgttacggattggcaaatcttatcatcggtcggtgtttggtcttgctttgtgactttgataataacatcgattcccatatgatgtttgttttcttcttccgtacacgatgaggatgattgctgaagactggcaggcacatgcatgccagtacgatatattgtttcatgattgctattgattgagtactgttctttatgattctacttccttaccgtgcaataaattagaatatattttctacttttacgagaaattaattattgtatttatgggtgaaaaacttactataaaaagcgggtgggtttggaattagtgatcagtttatgtatatcgcaactaccgggcatatggctacattacccacatgataagagattgtatcagtttcgtagtcttgagtattggtattactatatagtatatagatgtcgacgctagagttactgtctccgaatgcggcatgatagtatcattctttgctttcgttaactgtttggaggaagaatctttgttattgcatttaatctcgaaattcagagtgcacacctttctcctgtaaagaatcctgaagttgctaccttattaagaacggagaagtatccatcacgaaagacgggattacagtctttatgattcatagtaatagttagttccgacgttgagatggattcgctgagaccggtagtggtcgtccgagtacacgatgtgtcgttgacgggatacagattaatttccacatcgatatagttaaaggtatttctgggtacgggtttgagatcgtcgtacatgggaaatgaaatgtgactgtctgaatgtatggctttaagatagctgtgataccgtatacaggtcggtgtcggagattcgaatctctttaaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttaatcataggtagagatactttcagtctgtggtggatgatgtcattcacaacatccgccttgtatatgatgtttctgttttcaaacaccaagtcgaataccgtctttagtcggaaggttgatgtcgtatccgatgtatgaggcaacattgttgttacaattttgaaaggcggtattatagtattcgtctttctgaatgtcgaacctatctagtagataccgtagtatattgagagtgtatccttgattatgttttatgaatagataaagtagatgttgtccttcttccttttgttcgtgccaattgagtaacattatgagaatatgacctgttgcacaatcgttccatgatgggtgtacaatcaagattattacgtatcctcgtatcggctcctcgagataaaagagcatacaccacacgaggactatgtttggtatactgttgaaggtaagtgtgtaaccgcgttaatgtttgctccataatctattatcgcgtagatgaatcgcttctcggctcgcatcttagtgtgacttaacttgtaataattgcttttgtagaacgtggatatgtgtttacagtagtaatgaagagaagtgagtccatcctcgtcgacgcaattagggtcggatcctttgtacagaacgtaatagtttaagctcccattgaatttatatctaagataacacagcaatagatcggatgatttactaaagtcatcaatggtgtccgttagtatatcaaagatcttgttatcgattgatagtgaatgaatcagatagtggtgtagaggaatatgtcctttttcatccttgctatcaaagttacgcatgccgtggtgtaacaatatctttaatacagatggattaaatcgtgtattcatcgtatagcaatgtaatggagagttacctcgtttattcagatcgcagtgtttaataactagcttaaacagatgagacgatgtatccacatcaaagaacgtaaaatacatatgacaaacattgttgacagaaacgtgaccttcattcttaccgtcgtccataaatacgttaggtatgtaccacatactgtcgcgaacgatgcgtacaatctcgtccatctcataatgatttactttttcataattaaagatgtgaaagaaaaacagaacaatatatttttttagtaatgtttatgcgagacatataaaataaactccgtgtttatgatcatttttaacagcaacacattcaatattgtattgttatttttatattatttacacaattaacaatatattattagtttatattactgaattaataatataaaattcccaatcttgtcataaacacacactgagaaacagcataaacacaaaatccatcaaaaatgtcgatgaaatatctgatgttgttgttcgctgctatgataatcagatcattcgccgatagtggtaacgctatcgaaacgacatcgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattattattacgtgttgtctattatctgtttataggttcactcgacgaactaaactacctatacaagatatggttgtgccataatttttataaatttttttatgagtatttttacaaaaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcgaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttctttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtactatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccgatcggtaattgtctgccggtgtaatagaattatatatatctatctattacaccggctgagtatgcataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattaataacattacatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaatgtggttattgattggataaccgatgtgattgttcaatcaatattaagagggttggtaaattggtacatagctaataatacctatactccaaatacacccaataatacaacaaccatttctgagttggatatcatcaaaatactggataaatacgaggacgtgtatagagtaagtaaagaaaaagaatgtggaatttgctatgaagttgtttactcaaaacgatagatactttggtttattggattcgtgtactcatatattttgcataacatgcatcaatatatggcataaaacacgaagagaaaccggtgcgtcggataattgtcctatatgtcgtacccgttttagaaacataacaatgagcaagttctataagctagttaactaataaataaaaagtttaatttgttgacgacgtatgtcgttatttttctcgtatgaaagattaaattcaattcaattcgttgtttctaatataatctgccgtattggatggattctcaagacaattgcatttagattatattatcatgaataaaaatagtagcacgcactacttcagccaaatattcttttttgaaacgccatctatcgtagtgaggacacaagtgaacctataattatcaaatttattagtatcagtcacatgaaggactttctgtagagtgacgattctaccatctatggtactaacggtttcatcctccttgataccctcacccaaatgttctataaatttagcatcctcgtccgatctcatatcctttgccaaccaatacatgtagctaaaattaggcataaatttcacacatccagtgcaacgaaattctccagaagatgttacgatgtttaggttaggacatttgatttcgtcggcattaacatatgggtgaacacacccatacatgaaagcgatgagaaataggattctcatcttgccaaaatatcactagaaaaaatttatttatcaattttaaaggtataaaaaatacttattgttgctcgaatattttgtatttgatggtatacggaagattagaaatgtaggtattatcatcaactgattctatggttttatgtattctatcatgtttcactattgcgtcggaaataatatcatatgcttccacatatattttattttgttttaactcataatactcacgtaattctggattattggcatatctatgaataattttagctccatgatcagtaaatattaatgagaacatagtattaccacctaccattatttttttcatttcgttcaattcttgattgcaaagatctatataatcattatagcgttgacttatggactctggaatcttagacgatgtacagtcatctataatcatggcatatttaatacattgttttatagcatagtagttatctacgatgttagatatttctctcaatgaatcaatcacacaatctaatgtaggtttatgacataatagcattttcagcagttcaatgtttctagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagaccctttttgtatgtataagtgtaaaaattataacattcatagttggatttacataggtgtccaatcgggatctctccatcatcgagataattgatggcatctcccttccttttttagtagatatttcatcgtgtaagaatcaatattaatatttctaaagtattcgtgtatagcctctttatttaccacagttccatattccactagagggatatcgccgaatgtcatatactcaattagtatatgttggaggacatccgagttcattgttttcaatatcaaaaagatggtttccttatcatttctccatagtggtacaatactacacattattccgtgcggctttccattttccaaaaacaatttgaccaaatctaaatctacatctttattgtatctataatcactatttagataatcagccataattactcgagtgcaacatgttagatcgtctatatatgaataagcagtgttatctattcctttcattaacaatttaacgatgtctatatctatatgagatgacttaatataatattgaagagctgtacaatagtttttatctatagaagacggcttgattccgtgattaattagacatttaacaacttccggacgcacatatgctctcgtatccgactttgaatacagatgagagatgatatacagatgcaatacggtaccgcaatttcgtagttgataatcatcatacgcgtatcagtactcgtcctcataaagaacactgcagccattttctatgaacaaatcaataattttaggaacaggatcattgtcattacataattttctataactgaacgatggttttcacatttaacactcaagtcaaatccatgttctaccaacacctttatcaagtcaacgtctacatttttggatttcatatagctgaatatattaaagtcatttatgttgctaaatccagtggcttctagtagagccatcgctatatcctttaactttaacatgtctactatttgtgtattcttctaatggggtagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctctcaacatctgtttaagttcatcgagagccacctcctcattttccagatagtcaaacattttgactgaatgagctactgtgaactctatacacccacacaactaatgtcattaaatattatttttttgaatgtatttataccatgtcaaaaacttgtacaattattaataaaaataatttagtgtttaaattttaccagttccagattttacacctccgttaaccccactttttacaccactggacgatcctcctccccacattccaccgccaccagatgtataagttttagatcctttattactaccatcatgtccatggataaagacactccacatgccgccactactaccccctttagaagacatattaataagacttaaggacaagtttaacaataaaattaatcacgagtaccctactaccaacctacactattatatgattatagtttctatttttacagtaccttaactaaagtctctagtcacaagagcaatactaccaacctacactattatatgattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgacttaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacgtaaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctcttttttgtgtgaaattaaatagtttatcacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttctctacaatattaataccatttttgatactatttatttctatacctttcgaaattagtaatttcaataagtctatatcgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcgatcagatcaatgtctagatctatagaatcaaaacacgataggtcagaagataatgaatatctgtacgcttctttttgtactgtaacttctggttttgttagatggttgcatcgtgctttaacatcaatggtacaaattttatcctcgctttgtgtatcatattcgtctctagtataaaattctatattcagattatcatgcgatgtgtatacgctaacggtatcaataaacggagcacaccatttagtcataacagtaatccaaaattttttaaagtatatcttaacgaaagaagttgtgtcattgtctacggtgtatggtactagatcctcataagtgtatatatctagagtaatgtttaatttattaaatggttgataatatggatcctcatgacaatttccgaagatggaaatgagatatagacatgcaataaatctaatcgaagacatggttactccttaaaaaaatacgaataatcaccttggctatttagtaagtgtcatttaacactatactcatattaatccatggactcataatctctatacgggattaacggatgttctatatacggggatgagtagttttcttctttaactttatactttttactaatcatatttagactgatgtatgggtaatagtgtttaaagagttcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaatttcttgtaatcattcgaaataatttttagtttgcatccgtagttatcccctttatgtaactgtaaatttctcaacgcgatatctccattaataatgatgtcgaattcgtgctgtatacccatactgaatggatgaactaacgaatatcaacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaagagaaatcagtttaggaagaaaaaaattatctatctacatcatcacgtctctgtattctacgatagagtgctactttaagatgagacatatccgtgtcatcaaaaatatactccattaaaatgattattccggcagcgaacttgatattggatatatcacaacctttgttaatatctacgacaatagacagcagtcccatggttccataaacagtgagtttatctttctttgaagcgatagtttgtagagatcttataaaaccgtcaaacgacatcgcatttatatctttagctaattcatatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactagttatcaaagtgtctaggacgcgtaattttcatatggtatagatcctgtaagcattgtctgtattctggagctattttctttatcgcattagtaagttcagaatatgttataaatttaaatcgaataacgaacatgactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatagattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacaccagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaactgatatccgctattacaagagtacgttatactagagccaaagtctactccgccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagtttccacactattcttaaattttatattaatgggacgtgaaggaataggacagtatgatagaacgcatcctattcccaacaatgtcaggaacgtcacgctctccaccttcatatttatttatccgtaaaaatgttatcctggacatcgtacaaataataaaaaagcccatatatgtttgctattgtagaaattgtttttcacagttgctcaaaaacgatggcagtgacttatgagtttcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtataattctatccatttgtcttccttaactatatatttgtatagataattacgagtctcataagtaattccagtaattgcatagatgtcaccatcgtactctacagcataaactatactatgatgtctaggcatgggagacttttttatccaacgatttttagtgaaacattctacatcgtttaatactacatatttctcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctaacatcgacgcattatatagttttttaattccatattgtttagaaaagttaaacatccttatacaatttgtggaattaatattatgaatcatagtttttacacatagatctactacaggcgtaacatcaattattacggcagcaactagtatcatttctacattgtttatggtgatgtttatcttcttccagcgcatatagtctaatagcgattcaaacgcgtgatagtttataccattcaatataatcacttcatcatttatatggtgctcctgaatgcgtttaaaaaaattatacggagacgccgtaataatttccttattcacttgtataatttccccattgatagaaaatatcacgctttccattcttgaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctattatatggtatagggagagtataaaacattaaatgcccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatcctcagtcatcttgtctagaatggcaaatctaactgcgggtttaggctttagtttagtttttatatctacatctatgtctttatctaacaccaaaaatataatagctaatattttattacaatcatccggatattcttctacgatctcactaactaatgtttctttggttatactagtatagtcacgatcagacaaataaagaaaatcagatgatcgatgaataatacatttaaattcatcatctgtaagatttttgagatgtctcattaaaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgattagttaacaactattttttatgttaaatcaattagtacaccgctatgtttaatacttattcatattttagtttttaggattgagaatcaatacaaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttattcttttaaacagatcaatggtgtgatgttgattaggtcttttacgaatttgatatagaatagcgttcacatatcctccataatggtcaatcgccatttgttcgtatgtcataaattctttaattatatgacactgtgtattatttagttcatccttgttcatcattaggaatctatccaaaatggcaattatactagaactataggtgcgttgtatacacatattgatgtgtctgtttatacaatccatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatggcatcttcacaaattatatcattgtctaatagatatttgacgcatcttatggatcccacttcaacagccatcttaaaatcggtaaaatcatattgctttcctttatcattaataatttctaaaacatcatctctatcataaaagatacaaatattaactgtttgatccgtaataacattgctagtcgatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttattatgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagttcttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctactgaatacccgagagatgcgatacaaaagagtaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgactatatcgagatcttttgtataggagtcagacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtggtgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgcatctttgctagagagaaagcttttcagctgcttagacttccaagtattaattcgtgacagatccatgtctgaaacgagacgctaattagtgtatattttttcattttttataattttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccatgatagtagatgcctctgctacagttccttgttcgtcgacatctatctttgcattctgaaacattttataaatatataatgggtccctagtcatatgtttaaacaacgcattatctggattaaacatactaggagccatcatttcggctatcgacttaatatccctcttattttcgatagaaaatttagggagtttaagattgtacactttattccctaattgaaacgaccaatagtctaattttgcagccgtaatagaatctgtgaaatgggtcatattatcacctattgccaggtacatactaatattagcatccttatacggaaggcgtaccatatcatattcttcgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgcagacgataggtagacactgaacacgttaacgatagtatcaataacgcaatcatgattttatggtattaataattaaccttatttttatgttcggtataaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcaaagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttatatctattttattcaagagaatattcaggaatttctttttccggttgtatctcatcgcagtatatatcatttgtacattgtttcatattttttaatagtctacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatatacgccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggctcttcttaattcatcttctatataaggccaaaacaaaatattgcctgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacaccacttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattctttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcttactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtctctgtaatcactgcgattgtattatccggattcattttatttgttaaaaaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatctcattgtttgttccctggagtatgagagtcggggggtgttaatcttgggaattatttttctaaccttgttggtagccttcaagacctgactagcaaatccagccttaattttttcatgattgattaatgggtcgtattggtatttataaactttatccatatctctagatactgattctggacatagctttccgactggcgcatttggtgtgatggttcccataagtttggcagctagcagattcagttttgaaacagcatctgcattaactagaggagacattagaatcattgctgtaaacaagtttggattatcgtaagaggctagtatagaaattgttgctcccatggaatgcccaataagaagactggaactcctaaataagtagatttaatagttaccacgtgctgtaccacatctctaacatacgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtctattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaatttggttataaatgaaattgtcgccaatcttacacccaaccccttgttatccattagtatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcatgtactataccattatctatatcatctacataatctacgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcaaatcttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatagatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgctttatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatacgagtaaataactatagaagttaaactgtgaatgtcaaggtctagacaaaccctcgtaactggatctttatttttcgtgtatttttgacgtaaatgtgtgcgaaagtaaggagataactttttcaatatcgtagaattgactattatattgccacctatagcatcaataattgttttgaatttcttagtcatagacaatgctaatatattcttacagtacacagtattaacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatagatctaacggtttcttcactcggtggatacaataaatgtttaaacatcaaacatgcgaagtcgcagtgtagaccctcgtctctactaattagttcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcataatattggattgggaaaataacaaatctatttggatttggtgcaaggatgggttccataactaaattaacaatatcaataaattttttttcagttatctatatgcctgtacttggattttttgtacatcgatatcgccgcaatcactacaataattacaagtattattgatagcattgttattagtactatcataattaaattatcgacattcatgggtgctgaataatcgttattatcatcattatcattttgtaattgtgacatcatactaaataaatcgtttgcgagattgttgtgggaagcgggcatggaggatgcattatcattattatttaacgccttccatttggattcacaaatgttacgcacattcaacattttatggaaactataattttgtgaaaacagataacaagaaaactcgttatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgttagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaattcattttcaattataatatactggtaatgaccattaaaataaaaatattcttcataaccggtaagaaagtgaaaagttcacattgaaactatgtcagtagtatacatcatgaaatgagatgaaatgatgatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtagtcgccgactgtcgtgtttgcgtttagatccctccattatcgcgattgcgtagatggagtactattatataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcttcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgtcttggtacacatgatgaattcttctaatgctgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcagcatggtagttcgtaaattttaatgtataacagagccatctgtaaaaagataaactttatgtattgtaccaaagatttaaatcctaatttgatagctaactcggtatctactttatctgcagaatacagtgctaggggaaaaattataatatttcctctttcgtattcgtagttagttctcttttcatgttcgaaaaagtgaaacatgcggttaaaatagtttataacattaatattactgttaataactgccgggtaaaagtgggatagtaatttcacgaatttgatactgtcctttctctcgttaaacgcctttaaaaaaactttagaagaatatctcaatgagagttcctgaccatccatagtttgtatcaataatagcaacatatgaagaacccgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccctattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaactattaactattttgtctctgtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtattgtattagagtattaatatgcgcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactgtgaccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcaatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaacagtctttaagttctggaatattatcatcccattgtaaagcccctaattcgactatcgaatatcctgctctgatagcagtttcaatatcgacggacgtcaatactgtaataaaggtggtagtattgtcatcatcgtgataaactactggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattatttactataatataatctagacagatagatgattcgataaatagaaaaggtatatcgttggtaggataatacatccccattccagtattctcggatactctattaatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacagttattgggccagtatactgttagcaacggtatatcgaatagattactcatgtaacctactagaatgatagttcgtgtactagtcataatatctttaatccaatctaagaaatataaaattagatcttttacactgttaaagttaacaaaggtattacccggatacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagagaacttacgatacatctgtttcctgtaatcgttaaattttacaaatctataacatgctaaaccttttgacgacaaccattcattaatttctgatatggaatctgtattctcgataccgtattgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaagatttgtaccctgtttaacatgatggcgttctatacgtttctattttctattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcgtctagacttctggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcagacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtttatttctatatccgtatccattgtagattgttgaccgattatcgagtttaaatcattactaatactcaatccttcagaatacaatctgtgtttcattgtaaatttataggcggtgtatttaagttggtagattttcaattatgtatcaatatagcaacagtagttcttgctcctccttgattctagcatcctcttcattattttcttctacgtacataaacatgtccaatacgttagacaacacaccgacgatggcggccgccacagacacgaatatgactaaaccgatgaccatttaaaaacccctctctagctttcacttaaactgtatcgattattcttttagaacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacaaatcgtcgaaaactagttatagttaacattttattatttgataccctgatattaatacccctgccgttactattatttataactgatgtaatccacgtaacattagaattaattatcgatagtaatgcatcgacgcttccaaaattgtctattataaactcaccgataatttttttattgcatgttttcatattcattaggattatcaaatctttaatcttattacgattgtatgcgttgatattgcaagacgtcattctaaaagacggaggatctccatcaaatgccaaacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatgtatgtaaaaatatagtagaatttcattttgtttttttctatgctataaatgaattctcattttgcatctgctcatactccgttttatatcaataccaaagaaggaagatatttggttctaaaagccgttaaagtatgcgatgttagaactgtagaatgtgaaggaagtaaagcttcctgcgtactcaaagtagataaaccctcatcacccgcgtgtgagagaagaccttcgtccccttccagatgcgagagaatgaataacccaggaaaacaagttccgtttatgaggacggacatgctacaaaatatgttcgcggctaatcgcgataatgtagcttctagacttttgtcctaaaatactattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtgacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttttgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatattttttaatgtaaagagtgatcaaatcattgtgtttattgtaccatcttgttgtaaatgtgtattcggttatcggatctgctcctttttctattaaagtatcgatgtcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacgaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatctgccttatcgaatactcttccgtcgatatctacacaggcataaaatgtaggagagttactaggccccactgattcaatacgaaaagaccaatctctcttagttatttggcagtactcattaataatggtgacagggttagcatctttccaatcaataatttttttagccggaataacatcatcaaaagacttatgatcctctctcattgatttttcgcgggatacatcatctattatggcgtcagccataacatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacacaaccagcaataaaactaatttattttatcatttttttattcatcatcctctggtggttcgtcgtttctatcgaatgtggatctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcatgtctaactagtggaggttcgtcagcggctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattaggactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggaaaataattggaacacaagttgataaaatgttgatagctgaatctgataaatatacaatagatgcaaggtataacctaaaacccatgtatagaatcaagggagaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaagatatatatactctatttcaacaaactggtagaatcgtccatagcaatctaacagaaacgtttagagattatatctttcccggagataagactagctattgggtgtggttaaacgaaagtatagctaatgatgcggatatcgttcttaatagacacgccattaccatgtatgataaaattcttagttatatatactctgagataaaacagggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttaagagataatctatatcatgtagaagaattcttggataaaagcatccatctaaccaagacggataagaaatatatacttcaattgataagacacggtagatcatagaacagaccaaatatattattaataatttgtatatacatagatataattatcacatattaaaaattcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcagagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattccagtatacgaagaaaaagtaaatactgaattcattgctaatggatcgttctctggtagatacgtatcatatcttcgaaagttttctgctcttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataggtatcaaagatataaatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtacattagccggacaaatatatgcaaaataatatcgttctccaagttctatagtttctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggtcttgtatgtcttaatcatattcttatgaaacttggaaacatctcttctagtttcactagtacctttattaattctctcaggtacagattttgaattcgacgatgccgagtatttcatcgttgtatatttcttcttcgattgcataatcagattcttatataccgcctcaaactctattttaaaattattaaacaatactctattattaatcagtcgttctaactcctttgctatttctatggacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttaacatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaagagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtccgtagtatcgtcaccgatgaacgtcatttctctaactcctctatttaatactttacccatgcaactgaacgcgttcttggatatagaatccaatttgtacgaatccaatttttcagatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacatagtcgaacgttagttccaacaattgtttagctattcgtaacaaaactatttcagaacataaaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcaccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacgactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacaaatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgttcaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatggagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcgtctgtgcgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacaaggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccatcgtacatggttggaagatgctcgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagtgtagctcctacaggaatatctttaactaagtcaatgatttcatcaaccgttagatctattttaaagttaatcatataggcattgatttttaaaaggtatgtagccttgactacattctcattaattaaccattccaagtcactgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaaaaacctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattatttttatattttctcaacaagttctcaataccccaatagatgatagaatatcacccaatgcgtccatgttgtctatttccaacaggtcgctatatccaccaatagaagttttcccaaaaaagattctaggaacagttctaccaccagtaatttgttcaaaatagtcacgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggtattaagaattcgtttttcgacatctgtcaaaaccaattcctttttgcctgtatcatccagttttccatcctttgtaaagaaattattttctactagactattaataagactgataaggattcctccataattgcacaatccaaactttttcacaaaactagactttacaagatctacaggaatgcgtacttcaggtttcttagcttgtgattttttcttttgtggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtgactgttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagtgcgaatgtaatttttgtttccgttccggatctatagaaaactacaggtgtgataattgccttggccaattgtctttctcttttactgagtgattctagttcaccttctatagatctgagaatggatgattctccagtcgaaacatattctaccatggctccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcacaaaccaccggtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtacgtagcgtacaaaatgattgttcctggtatatagataaagagtcctatatatttgaaaatcgttacggctcgattaaactttaatgattgcatagtgaatatatcattaggatttaactccttgactatcagggcggcaccagaaattaccatcaaaagcattaatacagttatgcctatcgcagttagaacggttatagcatccaccatttatatctaaaaattagatcaaagaatatgtgacaaagtcctagttgtatattgagaattgacaaaacaatgtttcttacatattttttttttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtgaacgtcttgggcgtcggaaaggatgattcgtcaaacgaataaacaatttcacaaatggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaatggagtaaaataaatatcattaatatatgctctaaatattagtatttttattaatcctttgattatcatcttctcgtacgcgaatgattccatgatcaagagtgatttgagaacatcctccggagtattaatgggcttagtaaacagtacatcgttgcaataataaaagttatccaagttaaaggatattatgcattcgtttaaagatatcacctcatctgacggagacaattttttggtaggttttagagactttgaagctacttgtttaacaaagttattcatcgtcgtttactattctatttaattttgtagttaatttatcacatatcacattaattgactttttggtccacttttccatacgtttatattcttttaatcctgcgttatccgtttccgttatatccagtgatagatcgtgcaggttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttctacattaatacagcctattttcgctccaaatgtacattcgaaaaatctgaataaaacatcgatgtcacaatttgtattatccaatacagaatgtctgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaagaaatacgctaacggtatactagtaggtaactcaaagacatcatatatagaatggtaacgcgtctttaactcgtcggttaactctttcttttgatcgagttcgtcgctactattgggtctgctcaggtgccccaactctactagttccaacatcataccgataggaatacaagacactttgccagcggttgtagatttatcatatttctccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactaactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgaccgagaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtaaagtttttgtccccgctccttttggaggatcgcaagaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaattagtccatcatttgttgcgtcaagaactactatcggatgttgttgggtatctctagtgttacacatggccttactaaagtttgggtaaataactatgatatctctattaattatagatgcatatatttcatttgtcaaggatattagtatcgacttgctatcgtcattaatacgtgtaatgtaatcatataaatcatgcgatagccaaggaaaattcaaatagatgttcatcatataatcgtcgctataattcatattaatactttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagacgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttatgatgacttgataacttactttccagataggaaataccataaatatatttctaaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagagaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaaccggtggccaaactccataatttgctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcaaagtttcctattagggttccgcgctttacgtcacccagcatacttgaatcaccatcctttaaaaaaaatgataagatatcaacatggagtatatcatactcggattttaattcttctactgcatcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgctagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctactgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatgttcctccttgtcaatgcactgttcaagaatttatattttccgcattagatgaaaaatggaacaattttaaatcatcttatttagagaccgttccgttaccctgccaattaatgtatgcattagaaccacgcaaggagattgatgtttcagaagttaaaactttatcatcttatatagatttcgaaaatactaaatcagatatcgatgttataaaatctatatcttcgatcttcggatattctaacgaaaactgtaacactatagtgttcggcatctataaggataatttactactgagtataaatagttcattttactttaacgatagtctgttaataaccaatactaaaagtgataatataataaatataggttactagattaaaaatggtgttccaactcgtgtgctctacatgcggcaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcatgatagaatgtattgttttaaattggtagctgaatgttataaaaatgccggtattgatacatcgtctaaacgaatattaggtaaagatatttttctgagccaaaacttcacagatgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgccggacaatagcacaattgtttagctttggactctatgtattcagaattaatagatatatctcttaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtatctataaatgtagactcgacggatgagttaatgtatatttttgccgccttgggcggatctgtaaacatttgggccattatacctctcagtgcatcagtgttctaccgcggagccgaaaacattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatttagaatggttgttgggctttatcaagtgtattagtcagcatcagcatttggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattctaggaatgttgttttcggatagagttcaatcctttaagatcaacatctttatgacgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacaccggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgtgaatcatttttgcatcatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttgctaacacgtaattataataatttaggactttgcaatattgtacgatgtaatactagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaatgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaggcgttgatgcaattgacgactaaggccactactcaaatagcacctaaacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcactgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggcgttggtggcgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctatagcatactttttctttaccttgagaatatccatcgtttgcttggtcaatagcgatatgtgattttttatcaaccactcgaaaaagtaattggagtgttcatatcctctacgggctattgtctcatggccgtgtatgaaatttaagtaacacgactgtggtagatttgttctatagagccggttgccgcaaatagatagaactaccaatatgtctgtacaaatgttaaacattaattgattaacagaaaaaacaatgttcgttctgggaatagaaaccagatcaaaacaaaattcgttagaatatatgccacgtttatacattgaatataaaataactacagtttgaaaaataacagtatcatttaaacatttaacttgcggggttaatctcacaactttactgtttttgaactgttcaaaatatagcatagatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtttcggtggctgattaggctgtagtcttggtttaggctttggtatatcgttgttgaatctattttggtcattaaatctttcatttcttcctggtatatttttatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgtattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccatgagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttctttatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctattagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttaaacgttatcaaatagctcaatataaatgcgtgactataaaatattctaacgataatagatacggaacgggactatggacgcatgataagaataattttgaagcattggaagcaactaaactatgcgatgttttggaattaattacagatttctccgtgataggtatcgatgaaggacagttctttccagacattgttgaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagataaaaataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtgctactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggtgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaaaacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagcgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgctgattattagaccggctattagtttttggatagatagtatacccaaagaaaccaatgaattaacttacttattaggtatgatcgttaagaattgtaacttgaatgctgatgaacaggttatccagaaggcggtaatagaatacgatgatattaaaattatttctaataacactaccagtatcaatttatcatatatcacatccggcaaaaataatatgattagaagttatatcgtcgcccggcgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttatcaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcctacagaactaatgtatattctaggtacgtatggacaacaaaggattgatggtgaaccagcagagactcgagtattgggtagagtcttaccttactatcttccagactctaaggatccagaaggaagaggttacattcttaattctttaacaaaaggattaacgggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccagacatcactcttcgaaaagaaacagataggtatgtagtagatataatagtcaatagattatacatcaagagagcagaaattaccgaattagtcgtcgaatatatgattgaacgatttatctcctttagcgtcattgtaaaggaatggggtatggaaacattcattgaggatgaggataatattagatttactgtctacctaaatttcgttgaaccggaagaattgaatcttagtaagtttatgatggttcttccgggtgccgccaacaagggcaagattagtaaattcaagattcctatctctgactatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctctgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagtttagatttaacgttaaagatgagcataaacataataaacaaaattacaatcaaacctataacattaatatcaaacaatccaaaaaatgaaatcagtggagtagtaaacgcgtacataactcctggataacgtttagtagctgccgttcctattctagaccaaaaattcggtttcatgttttcgaaacggtgttctgcaacaagtcggggatcgtgttctacatatttggcggcattatccagtatctgcctattgatcttcatttcgttttcaattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaagtctatcaataactggcacaacaataacaggagttttcgccgccgccatttagttattgaaattaatcatatacaactctttaatacgagttatattttcgtctatccattgtttcacatttacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttcgaccgatggagtaggtgcaacaattttttgttcgatgtatgtatgtactggagccattgttttaactataatggtgcttgtatcgaaaaactttaatgcagatagcggaagctcttcgccgcgactttctacatcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagttcaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaaaaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttaattggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacgaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctttctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagcgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccatcaccaaaaaagttaatagcgttaactatcaaacaaactgctgaagtggtaggtcatactccatcaatttcaaaaagagcttacatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgaccgctttctttggggagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatttggagatgaatgcaagactcacgcatcgagtatagccgaacaattggcgtgtgcggatattattaaagaggatattagcgaatacatcaaaactactccccgtcttaaacgatttataaaaaaataccgcaatagatcagatactcgcatcagtcgagatacagaaaagcttaaaatagctctagctaaaggcatagattacgaatatataaaagacgcttgttaataagtaaatgaaaaaaaactagtcgtttataataaaacacaatatggatgccaacatagtatcatcttctactattgcaacgtatatagacgctttagcgaagaatgcttcagaattagaacagaggtctaccgcatacgaaataaataatgaattggaactagtatttattaagccgccattaattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccaatctaaaagttctttgttgcacgctattaatcatccaaagtcaaggcctaatacatctctggaaatagaattcacacctagagacaatgaaaaagttccatatgatgaactaataaaggaattgacgactctatcacgtcatatatttatggcttctccagagaatgtaattctttctccgcctattaacgcacctataaagacttttatgttgcctaaacaagatatagtaggtctggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatatgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagttgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagtttgataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtagataacgacgataacgaagtatttatacttttaggaaatcacaatgactttatcagatcaaaattaacaaaattaaaggagcatgtatttttttctgaatatattgtgactccagataaatatggatctttatgcgtcgaattaaatgggtctagttttcagcacggcggtagatatatagaggtggaggaatttatagatgctggaagacaagttagatggtgttctacatccaatcatatatctgaagatatacccgaagatatacacactgataaatttgtcatttatgatatatacacttttgacgctttcaagaataaacgattggtattcgtacaggtacctccgtcgttaggagatgatagctatttgactaatccgttattgtctccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaacaagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttagatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtagagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgtggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacagaaaatatcatgttcctattatgaaactatatcctacaccggaagagattccggactttgcattctatctcaaaataggtactctgttagtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgcctaatatcaacattttgaaaatttttaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttctactattgtctggatctcccattactaacacacctaatactctgggtcatattatagatttaatgtccgaagagacgatagattttggtgagattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggtggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggcagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtaacgtcattaaacgattacacacaggatgaattgattaatgttttaccatttgacatcaaaaagctgttgtatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgactccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgaaatatataaagaaataaatgtcgagctttgttaccaatggataccttccagttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgctgctcgtataatctccccagaataatatacttgcgtgtcgtcgttcaatttatacggatttctatagttctctgttatataatgcggttttccatcatgattagacgacgacaatagtgttctgaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatatttttttttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtctagaaagaaacgattatttctgaattattccaattatttgtccaaacaggaaagaagtatactatcgtcatttttttctctagatccagctactactgataatgatagaatagatgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctttaacgagtgatcaaatcattgatacatttaaaagtaatcatgaaatcaaggatctaatatttttagatccgaattcaggtaatggactccaatacgaaattgcaaaatatgctctagatactgcaaaactcaaatgttatggccatagaggatgttattacgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatgtacgaacataggcctcctagtttggagactaattctttctcatcaactagacgtttattctcaaatagcgattggtgttgtaaggatcctggtcgtagtaagttaaccaacatggtgaattcttgcacactattaacgataggtgtagccgataaacaaatcatcttatggttttttaatgcgatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacgggcatattagtagttctgcgcaatgcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctcaacaatctcggcagactccggataaccagtcggtgggccatcactaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaaccgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaagtttattgtatttataaccttttccttatcttcatagaatactaaaggcaacaaagaaatttttggttcttctctaagagctacgtgagacttaaccatagacgccaacgaatccctacatattttagaacagaaatacccaacttcaccacccttgaatgtctcaatactaataggtttaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacatactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacatggaagtttgactttttttgtacctttgtacatttttgaaataccgactcgcaaaaaatacaatattcatatccttgttcagatactataccgttgtgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatattgttaccgtcttccgccaatatagtagttaaattatccgcacatgcaaaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcatgatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatatcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgtgtagatgctacttcgtcgatggaaaccatacaatcctttttgataggctgttgagattgattatttcctgcacgtttaggtttggtacgttgatttctagcccctgcagatataaagtcatcgtctacaattttggataatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactagttgtagaatttgatctattgccctacgcgtatactcccttgcatcatatacgttcgtcaccagatcgtttgtttcggcctgaagttggtgcatatctttttcaacactcgacatgagatccttaagggccatatcgtctagattttgttgagatgctgctcctggatttggattttgttgtgctgttgtacatactgtaccaccagtaggtgtaggagtacatacagtggccacaataggaggttgaggaggtgtaaccgttggagtagtacaagaaatacttccatccgattgttgtgtacatgtagttgttggtaacgtctgagaaggttgggtagatggcggtgtcgtcgtcttttgatctttattaaatttagagataatatcctgaacagcattgctcggcgtcaacgctggaaggagtgaactcgccggcgcatcagtatctgcagacagccaatcaaaaagattagacatatcagatgatgtattagtttgttgtcgtggttttggtgtaggagcagtactactaggtagaagaataggagccgatgtaggtgtcggaaccggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatcctttttttcagaataatagattgacgactttggtgtagaggattctgccagcccctgtgagaacttgttaaagaagtccatttaaggctttaaaattgaattgcgattataagattaaatggcagacacagacgatattatcgactatgaatccgatgatctcactgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatccgatatgaatttgataagactttgaacattattaatacccgtctgtttaattttttctacagatattttagttttggcagattctatcgtatctgtcaatagacatccaacatcgacattcgacgtcaattgtctataaatcaacgtataaattttagaaataacattagcgaattgttgtgcattgatgtcgttattctgaaacagtatgattttaggtagcattttcttaacaaagagaacgtatttattgttactcagttgaacagatgatatatccagattactaacgcatctgattccgtataccaaactttcagaagaaatggtgtacaattgtttgtattcattcaatgtctccttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacgatctccattatttttttggaatcggatactatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtatagaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaaaataatagggagaaatgacattttggattctgttacgactttaccaaaattaaggatatacggacttactatctttttctcaacgtcaatttgatgaacacacgatgaaaatgtgcttctatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctatagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagggtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattattactaccatcattattagtattcttcttgttatcttgttcagaaatatacagcaatgctatgcctaatactaaatacattatcatgcttgcaatggctctaacaacgacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtaacaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactcttcaaagtttctgaaataagattagtaacagtcttacctccgactactctgggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgaagtagtatcaattaaataattaatgcccaatttggatatagcagcctgaagctcatcttgtttagttacggatcctaatgagttattaagcaatatatcgaacggatgaacgaaggttgttttgagtttgtcgcatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattaatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtataaatcaacagaagttaataagcgtatagccatcgttaattatgcaaatttgaacgggtctcccttatcagtcgaggacttggatgtttgttcagaggatgaaatagatagaatctataaaacgattaaacaatatcacgaaagtagaaaacgaaaaattatcgtcactaacgtgattattattgtcataaatattatcgagcaagcattgctaaaactcggatttgaagaaatcaaaggactgagtaccgatatcacttcagaaattatcgatgtggagatcggagatgactgcgatgctgtagcatcaaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtttaggagcaccagaagtatttttggagcccttggaggctgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggattcagattttgtaagttcttgatcttattatacatcgagtataggatggcgacagtaactgctacacaaataccgatcaaaagaagaataccaatcatttattgacaataacttcactattgatcaagtatgcaatatatcatcttttcactaaataagtagtaataatgattcaacaatgtcgagatatatggacgataataatttagttcatggaaatatcgctatgattggtgtgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgactctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttctttgaacatcttgattataatataaccattttctatctctagattcgtcggtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgctacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaacagaatttattgtaacagtattattaatattgccaagttatccgatctaaaaaaaactatctatgcggtagatagtttttttgagccatattccacagacaatattagacatatgataaaacgattagatggaccatctaataaatatcatatatatactgagaagttattatctgtagacgagcctagaaatcaacttattcttgataccctggtagaagaattcaagtcaggaactattaatcgcattttagttattactaaactacgtgaacatatggtattcttctacaaacgattattagatcttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgtatgtacaacatcctccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcggctcttcattccggaacgcacattggtgctatccatttaggtagtaaaaaataagtcagaatatgccctatagcacgatcgtgcaaaacctggtatatcgtctctatctttatcacaatatagtgtatcgacatctttattattattgacctcgtttatcttggaacatggaatgggaacatttttgttatcaacggccatctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttaggcggcaagttgtagactttttcaaattctcgttcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatatcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaggatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactgattcagaaatggatcaacgactcggatataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgattaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtggcatcttcattagtgggaatcaatcacaattctggacccagagctattcttggatgtgctcaagctaaacaagctatctcttgtctgagttcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatatagttaccgcaaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacgccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtctgatgaagaattatcggataaaatcttttgtgaaaagattctctatgatcctgaaacggataagccttatgcatccaaagtattttttggaccaatttattacttgcgtctgagacatttaactcaggacaaggcaaccgttagatgtagaggtaaaaagacgaagctcattagacaggcgaatgagggacgaaaacgtggaggaggtatcaagttcggagaaatggagagagactgtttaatagcgcatggcgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaagacctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgtggatgttctggttcggcatccaccgatggtgtcacatcactaatcggttcggtaacgtctgtggatggaggtgctacttctacagaacctgtagcctcagttgtcaacggagatacatttttaatgcgagaaaatgtataatttggtaatggtttctcatgtggatctgaagaagaggtaagatatctactagaaagataccgatcacgttctagttctcttttgtagaacttaactttttctttctccgcatctagttgatattccaacctcttcacgttactacgttcagattccaattcacgttcgcatgggttacctccgcagtttttacgagcgatttcacgttcagccttcatgcgtctctccctctctctatcgagtttatcagagcagtctttctgaaggcgatcgaactccataaatttctccaacgctttgattgtttccatagatttccgaacttcagcttctaggacggcgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacttcctctcttgcttcttcgtcatagtacgcgcaatcactgtgagatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctgattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcagcattggtttcattattacgtctacagtcgttcaactgtctttcaagatctgatattctagattggagtctgctaatctctgtagcattttcacggcattcactcagttgtctttcaagatctgaaattttagattggagtctgctaatctctgtaagatttcctcctccgctctcgatgcagttggtcaacttattctctagttctctaatacgcgaacgcagtgcatcaacttcttgcgtgtcttcctggttgcgtgtacattcatcgagtctagattcgagatctctaacgcgtcgtcgttcttcctcaagttctctgcgtactacagaaagcgtgtccctatcttgttgatatttagcaatttctgattctagagtactgattttgcttacgtagttactaatagttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaaggaaaagaaaatattcagtgtataggtatgtcttggcgtcatatcttgtactaaacacgctaaacagtttgttaatgtgatcaatttccaatagattaattagagcagcgggaataccaacaaacatattaccacatccgtattttctatgaatatcacatatcatgttaaaaaatcttaatagaagagcgaatatctcgtctgacttaatgagacgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaatttattcaaaacttaactacaatcgggtaattataagatcgtaaatctcccatgtggcggaatactaccatctatcgcatgtggatggacagtaggtaatggccatgggaacagtaatgattgcatatttatctttcttgctagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcgaaaacagaatatcctaaaccatataatatatattcagggacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgctcattaataaaatttttatcattgctcgttatctcagaatcgtatatataaggagtaccatcgtgattcttaccagatattatacaaaatactatatataaaatatattgaccaacgttagtaatcatataaatgtttaacgttttaaattttgtattcaatgatccattatcatacgctagcatggtcttatgatattcattctttaaaatataatattgtgttagccattgcattggggctcctaatggagattttttattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatgggcgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatatcgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaatgatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttttactttctaatatagcgtttagattctttttcatgtgcgaatattgatttactaaaatatcgatgtttaacttttgttctatgacgtccttatcagcggtatcggtacatatacgtaattcaccttcacaaaatacggagtcttcgataataatagccaatcgattattggatctagcggtctgtatcatattcaacatgtttaatatatcctttcgtttcccctttacaggcatcgatcgtagcatattttccgcgtctgagatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctggattataaacgggtgtaaacaagaatatatgtttatattttttaactagtgtagaaaacagagatagtaaatagatagtttttccagatccagatcctcccgttaaaaccattctaaacggcatttttaataaattttctcttgaaaattgtttttcttggaaacaattcataattatatttacagttactaaattaatttgataataaatcaaaatatggaaaactaaggtcgttagtagggaggagaacaaagaaggcacatcgtgacataaataacatttattatcatgatgacaccagaaaacgacgaagagcagacatctgtgttctccgctactgtttacagagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacgcaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttaaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtacttaatgaagataccaaacagaatcctaactattcatccaatcctttcgtaaattataataaaaccagtatttgtagcaagtcaaatccgttcattacagaactcaacaataaatttagtgagaataatccgtttagacgagcacatagcgatgattatcttaataagcaagaacaagatcatgaacacgatgatatagaatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacgtcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactgtatgtaaacaatctatcactgattaattatttgccgttgtctgtattcattattagacgagttaccgactatttggatagacacatatgcgatcagatatttgcgaataataagtggtattccattataaccatcgacaataagcagtttcctattccatcaaactgtataggtatgtcctctgccaagtacataaattctagcatcgagcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgataaaaagaataagaataagatcaaggattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagtaccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagatggtaacgtcatcatcaacaatccaataatatgccggagagtaaacattgacggataaaacaaaaatgctccgcataactctatcatggcaataacacaaccaaatacttgtaagattcctaaattagtagaaaatacaacggatatcgatgtataagtgatctcgagaaataataagaataaagtaatgcccgtaaagataaacatcaacattgtttggtaatcattaaaccaattagtatgaagttgaactaatttcacagtagattttattccagtattatccccgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttatacacggcggataacgtaattccaaaagatggtttacgaggagcattcgtcgataaagatggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaaaaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaacttcgaaaccgttatttatagcagatatagggataggagtaggaatgccacaaatgaaaaaaatacttaaaatgtaatcttaatcgagtacaccgcacgacaatgaacaaacataagacagattatgctggttatgcttgctgcgtaatatgcggtctaattgttggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaaacctgggaggaaggacgtaatgcatgcaaagctctaaatccaaattcggatctaattaagatagagactccaaacgagttaagttttttaagaagccttagacgaggctattgggtaggagaatccgaaatattaaaccagacaaccccatataattttatagctaaaaatgccacgaagaatggaactaaaaaacggaaatatatttgtagtacaacgaatactcccaaactgcattcgtgttacactatataacaattacactacatttttatcataacactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccgcactcatcgtatattttgacgtatgcagtcacatcgtttacgcaatagtcagactgtagttctatcatgcttcctacatcagaaggaggaacagttttaaagtctcttggttttaatctattgccattagttttcatgaaatcctttgttttatccacttcacattttaaataaatgtccactatacattcttctgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaattagtgttcgagtgagtcggattatgtgagtactggattgtatattttattttatattttgtaataagaataaaatgctaatgtcaagtttattccaatagatgtcttattaaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgatgtgtatagaacgtgtagagatcacgctacccgtgtacgcgcaactggtaattaaaataaaaagtaatattcatatgtagtgtcaattttaaatgatgatgatgaaatggataatatccatattgacgatgtcaataatgccggtattggcatacagctcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgttacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcataatacgatctataaaaataagtatataataaatactttttatttacggtactcttgtagtggtgataccctactcaattatttttttaaaaaaatacttattctgattcttctagccatttccgtgttcgttcgaatgccacatcgacgttaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaattctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgcaccgcgtcatcatcgactgtacgatacataatgttaccgtgttgcttacattgctcgtaaaagactttcgtcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaatatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaagtataggtgtatggcattagccgaacatatatctgatagtattccaatatctgagctatctagactacgatacaatctatgtaagtatctacgcggacacactgagagcatagaggatgaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaaaaaaattatactgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagttttagttgtctagtatttaacaagagaagagatttcaacagactgtttatgaactcgaacgccgcctcattgtcgcttatattgatgatgtcgaattctcccaatatcatcactgatgagtagctcatcttgttatcgggatccaagttttctaaagatgtcattaaaccctcgatcatgaatggatttatcatcatcgtttttatgttggacatgagcttagtccgtttgtccacatctatagacgacgatttctgaattatttcatatatccctctctttaactccaggaacttgtcaggatggtctactttaatatgttctcgtctaagagatgaaaatctttggatggttgcacgcgacttttctttaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacaaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagatctatcagaccgaattgattaattcattagacgacaatgaaattatcgattgtatagttaacaagtttatgagcttttataaggataacctagaaaatatagtagatgctatcattactctaaaatatataatgaataatccagattttaaaactacgtatgccgaagtactcggttccagaatagccgatatagatattaaacaagtgatacgtaagaatatactacaattgtctaatgatatccgcgaacgatatttgtgaaaaatattaaaaaaaaatactttttttattaaatgacgtcgcttcgcgaatttagaaaattatgctgtgatatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatgtagcatctgtttgtacatgtaatgatttaaaatgtgtagtcatgcttattgataaagatctaaaaattaaagcgggccctcggtacgtacttaacgctattagtcctcatgcctatgatgtgtttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctaccgtttggaagtttaggaatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcctactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacaccatttagttggtggtcgccatggatggtgttattgtatactgtctaaacgcgttagtaaaacatggcgaggaaataaatcatataaaaaatgatttcatgattaaaccatgttgtgaaagagtttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgttattcctgttatcatatctataggaaaggataaagatgtctgtgaactattaatctcatcagacatatcgtgtgcatgcgtggagttaaattcatatcacgtagccattcttcccatgaatgtttccttttttaccaaaggaaatgcctcgttgattattctcctgtttgatttctctatcgatgcagcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacaattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggctatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattaatgatcacatgcttgataagataaaatctatactgcagaatagactagtatatgtggaaatgtcatagaaagttaatgagagcaaaaatatataaggttgtattccatatttgttattttttctgtaatagttaaaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatataaatctaaaattgatggataagatatacagctattaatttcgaaaatatattttaatctgataactttaaacatggatttttgatggtggtttaacgttttaaaaaaagattttgttattgtagtatatgataatattaaaagatggatataaagaatttgctgactgcatgtactattttttacattactacattggctacggcagatatacctactccgccaccaacgggtcatgtgacaagggagaatatcttgataagaggcataatcaatgttgtaatcggtgtccacctggagaatttgccaaggttagatgtaatggtaacgataacacaaaatgtgaacgctgcccacctcatacatataccacaatccccaattattctaatggatgtcatcaatgtagaaaatgcccaaccggatcatttgataaggtaaagtgtaccggaacacagaacagtaaatgttcgtgtcttcctggttggtattgcgctactgattcttcacagactgaagattgttgaaattgtgtaccaaaaaggagatgtccatgcggatactttggtggaatagatgaacaaggaaatcctatttgtaaatcgtgctgtattggtgaatattgcaactacctacgtaattatagacttgatccattttctccatgcaaactatctaaatgtaattaattatgattttgatgataatgttaccatacattatatcgctacttggttagtgtattattcagtatgaagacctattaataattacttatcttttgacgatcttgttataattataatataaaaacttatggcatagtaactcataattgctgacgcgataaattcgtaataatctgttttgttcaaatttttataaggaatctacaggcataaaaataaaaatataatttataatatactcttacagcgcgccatcatgaatagcagcagtaaattaattgctgttattaatggatttagaaatagtggacgattttgtgatattaatatagttattaatgatgaaaggataaacgctcacagactcatcctatctggagcctccgaatatttttccattctgttttccaataattttatcgattctaatgaatacgaagttaatctaagtcatttagattatcaaagtgttaacgatttgatcgattacatttatgggatacctttgagcctaactaacgataacgtgaaatatattctttcaaccgctgattttttacaaattggatctgccattactgagtgcgaaaaatacatacttaaaaatctttgttctagaaactgtatcgatttctacatatacgctgataaatataataacaagaaaatagaatcagcgtcgtttaacacaatattacgaaatattttgagactcatcaacgatgaaaactttaaatacttaacagaggaatcaatgataaaaattttaagcgatgatatgttaaatataaaaaatgaggattttgcaccactaattctcattaaatggttagagagtactcaacaatcatgcaccgtcgagttacttagatgcctcagaatatcattgctttccccacaagttataaaatcactttatagtcatcaactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgtcatgggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataatccgatatatgatgaatggaccaaattatcatcattaaacattcctagaattaatcccgctctatggtcagcgcataataaattatatgtaggaggaggaatatctgatgatgttcgaactaatacatctgaaacatacgataaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcaactacaaatgacactgataaagtagattatgaagaatactccacagagttgattgtaaatacagatagtgaatcgactatagacataatactatctggatctacacattcaccagaaactagttctgagaaaccagaggatatagataattttaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagaagatcatacagtcacagacactgtctcatacactacagtaagtacatcatctggaattgtcactactaaatcaaccaccgatgatgcggatctttatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacatattatatatataataaacgttcacgtaaatacaaaacagagaacaaagtctagatttttgacttacataaatgtctgggatagtaaaatctatcatattgagcggaccatctggttcaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaaactttctagaacatactgagtttttaggaaatatttacggaacttctaaaactgctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgttgtagaaacactgaagcggatgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtggctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggattcggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttggatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacgagtttcggcacatattaatgcagggtgtatattattaagtgtggtgtttggtcgatgtaaaatttttgtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgaatgcactcagttcaggacctatcatcgattaccacgtctggataggagattgtatctgtcaagttactgctgtggacgtacatggaaaggaaattatgagaatgagattcaaaaagggtgcggtgctacagatcccaaatctggtaaaagttaaacttggggagaatgatacagaaaatctttcttctactatatcggcggcaccatcgaggtaaccacctctcaagaagaccgcgtgaataatgtactcatgaaacgtttggaaactatacgccatatgtggtctgttgtatatgatcattttgatattgtgaatggtaaagaatgctgttatgtgcatacgcattcatctaatcaaaatcctataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtaaattagtcaaatttggtaattctattaattgttaaacatacatctgtttcagctaagcaactaagaacacgtatacggcagcagcttccttttatactctcatcttttaccaacacaaagggtggatatttgttcattggagttgataataatacacacaaagtatttggattcacggtgggttacgactacctcagactgatagagaatgatatagaaaagcatatcaaaagactttgtgttgtgcatttctgtgagaagaaagaggacatcaagtacacgtgtcgattcatcaaggtatataaacctggggatgaggctacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaactatagagaacaaataataggttgtaatatcatatagacaataactaacaattaattagtaactgttatctcttttttaactaaccaactaactatatacctattaatacatcgtaattatagttcttaacatctattaatcattgattcgcttctttaattttttataaactaacattgttaattgaaaagggataacatgttacagaatataaattatatatggatttttttaaaaaggaaatacttgactggagtgtatatttatctcttcattatatagcacgcgtgtgttccaattcttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcaggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgcagaagacagttacggttgtacattattacatagatgtatatatcactataagaaatcagaatcagaatcatacaatgaattaattaagatattgttaaataatggatccgatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacagaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaaaataaacaacataatgcagatttattgaaaatgtgtataaaatatactgcgtgtatgaccgattatgatactcttatagatgtacagtcgctacagcaatataaatggtatattttaaaatgtttcgatgaaatagatatcatgaagagatgttatataaaaaataaaactgtattccaattagttttttgtatcaaagacattaatactttaatgagatatggtaaacatccttctttcgtgaagtgcactagtctcgacgtatacggaagtcgtgtacgtaatatcatagcatctattagatatcgtcagagattaattagtctattatccaagaagctggatgcgggagataaatggtcgtgttttcctaacgaaataaaatataaaatattggaaaactttaacgataacgaactatccacatatctaaaaatcttataaacactattaaaatataaaatctaagtaggataaaatcacactacatcattgtttccttttagtgctcgacagtgtatactatttttaacactcataaataaaaatgaaaacgatttccgttgttacgttgttatgcgtactacctgctgttgtttattcaacatgtactgtacccactatgaataacgctaaattaacgtctaccgaaacatcgtttaatgataaacagaaagttacatttacatgtgatcagggatatcattctttggatccaaatgctgtctgcgaaacagataaatggaaatacgaaaatccatgcaagaaaatgtgcacagtttctgattatgtctctgaattatatgataagccattatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatataccgtctctatctaatggattaatttccggatctacattttctatcggtggcgttatacatcttagttgtaaaagtggttttatactaacgggatctccatcatccacatgtatcgacggtaaatggaatcccatactcccaacatgtgtacgatctaacgaaaaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtaaatataaatccgttaaaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcaacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacacgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaataaacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatccaagtggatatattagagaagcactcgttattaatacaagtagtaatagtgattccattgataaagaagttatagaatgtatcagtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactatataaggtcagaaaaaatttcactagttcgttctacaattacgtaatgaaaatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaaaacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattctttttttatagagtgtggtagtgttacggatatctaatattaatattagactatctctatcgcgctacacgaccaatatcgattactatggatatcttcagggaaatcgcatcttctatgaaaggagagaatgtattcatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctgatacctgtctcctagcaattagtgccgtatactttaaagcaaaatggttgatgccattcgaaaaggaatttaccagtgattatcccttttacgtatctccgacggaaatggtagatgtaagtatgatgtctatgtacggcaaggcatttaatcacgcatctgtaaaggaatcattcggcaacttttcaatcatagaactgccatatgttggagatactagtatgatggtcattcttccagacaagattgatggattagaatccatagaacaaaatctaacagatacaaattttaagaaatggtgtaactctctggaagctacgtttatcgatgttcacattcccaagtttaaggtaacaggttcgtataatcttgtggatactctagtaaagtcaggactgacagaggtgttcggttcaactggagattatagcaatatgtgtaattcagatgtgagtgtcgacgctatgattcacaaaacgtatatagatgtcaatgaagagtatacagaagcagctgcagcaacttgtgcactggtgtcagactgtgcatcaacaattacaaatgagttctgtgtagatcatccgttcatctatgtgattaggcatgttgatggaaaaattcttttcgttggtagatattgctctccgacaactaattgttaaccattttttttaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcagacaatgtttgactgaatatatttattggtcgtcctatgcataccgcaacaggcaatgcgctggacagttgtattccacactcctctcttttagagatgatgcggaatcagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctcaattacgtggattataacatcatattccggcgtatgaattgatgagttgtacatcttgacattttctttcttctcttctccctttcttctcttctcccttcctccctcttctccctttcccagaaacaaacttttttacccactataaaataaaatgagtatactacctattatatttcttcctatatttttttattcttcattcgttcagacttttaacgcgcctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacagaggtaaaacatataacgtaaccagaattgtaaaattagaggtacgggataaaataataccttctactatgcaattaccagatggcattgtaacttcaataggtagtaatttgactattgcgtgtagagtatcgttgagacctcccacaacggatgcagacgtcttttggataagtaatggtatgtattacgaagaagatgatggggacggagacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcatgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcttttattaatgtcaggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtacttgtatgtgttataaatataacgggatatagaactgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcaaatcaactcataaaatacaagagaatgaaatatatacatattttagtcattgcaatatagaccatacttctacagaacttgattttgtagttaaaaactatgatctaaacagacgacaacatgtaactgggtatactgcactacactgctatttgtataataattactttacaaacgatgtactgaagatattattaaatcatgacgtaaatgtaacgatgaaaaccagtagcggacgtatgcctgtttatatattgcttactagatgttgcaatatttcacatgatgtagtgatagatatgatagacaaagataaaaaccacttattacatagagactattccaacctattactagagtatataaaatctcgttacatgttattaaaggaagaggatatcgatgagaacatagtatccactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtccggcagattcgataacttatttgatgaataggtttaaaaatataaatatttatacccgctatgaaggaaagacattattacacgtagcatgtgaatataataatacacacgtaatagattatcttatacgtatcaacggagatataaatgcgttaaccgacaataacaaacacgctacacaactcattatagataacaaagaaaattccccgtataccatcgattgtttactgtatatacttagatatattgtagataagaatgtgataagatcgttggtggatcaacttccatctctacctatcttcgatataaaatcatttgagaaattcatatcctactgtatacttttagatgacacattttacgataggcacgttaagaatcgcgattctaaaacgtatcgatacgcattttcaaaatacatgtcgtttgataaatacgatggtataataactaaatgtcacgacgaaacaatgttactcaaactgtccactgttctagacactacactatatgcagttttaagatgccataattcgaaaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaagaatagacggcgacaggtttctaataaacgtgttaaacatggtgatttatggatagccaactatacatctaaattcagtaaccgtaggtatttgtgtaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgacattaagtattcacaaacgggaaagaaattaattattcataatccagagttagaagatagtggaagatacaactgttacgttcattacgacgacgttagaatcaagaatgatatcgtagtatcaagatgtaaaatacttacggttataccgtcgcaagaccacaggtttaaactaatactagatccaaaaatcaacgtaacgataggagaacctgccaatataacatgcactgctgtgtcaacgtcattattgattgacgatgtactgattgaatgggaaaatccatccggatggcttataggattcgattttgatgtatactctgttttaactagtagaggcggtattaccgaggcgaccttgtactttgaaaatgttactgaagaatatataggtaatacatataaatgtcgtggacacaactattattttgaaaaaacccttacaactacagtagtattggagtaaatacacaatgcatttttatatacattactgaataattattattattatttatatcgtatttgtgctataacgcgactatctaggtatttgtatctcactgatagagaacatataaatatagactctattaaacagttgtgtaaaatatcaaatcctaatagatgtggatgtacggctttacatgagtacttttataattatagatcagtcaacggaaaatacaagtatagatacaacggttactatcaatattatttatctagcgattatgaaaattataatgaatattattatgatgattatgatagaactggtatgaacagtgagagtgataatatatcaatcaaaacagaatatgaattctatgatgaaacacaagatcaaagtacacaactagtaggttacgacattaaactcaaaaccaatgaggatgattttatggctatgatagatcagtgggtgtccatgattatatagatgaatcaattaataaagtagtatatggaagagagtctcacgtaagatggcgggatatatggcaagaacataatgatggcgtatacagtataggaaaggagtgcatagataatatatacgaagacaaccataccgtagacgaattctacaagatagacagcgtatcagatgtagatgacgcggaacacatatctccgataactaatgatgtatctacacaaacatgggaaaagaaatcagagttagatagatacatggaaatgtatcctcgtcatagatatagtaagcattctgtctttaagggattttctgacaaagttagaaaaaatgatttagacatgaatgtggtaaaagaattactttctaacggtgcatctctaacaattaaggatagcagtaataaggatccaataaccgtttattttcgaagaacgataatgaatttagaaatgattgatattattaacaaacatacaactattgatgaacgaaagtatatagtacactcctatctaaaaaattataaaaatttcgattatccatttttcaggaagttagttttgactaataaacattgtctcaacaattattataatataagcgacagcaaatatggaacaccgctacatatattggcgtctaataaaaaattaataactcctaattacatgaagttattagtgtataacggaaatgatataaacgcacgaggtgaagatacacaaatgcgaactccattacacaaatatttgtgtaaatttgtatatcataatattgaatatggtatccgatactataatgaaaagattatagacgcatttatagagttaggagccgatctaactattccaaataacgatggaatgataccagtagtttactgtatacactcaaatgcagaatatggttataacaatattactaacataaagataatacgtaaactacttaatcttagtagacgtgcgtcacataatctatttagagatcgagtcatgcacgattatataagtaatacatatattgatcttgagtgtttagatattattagatcgttggatggattcgatatcaatggttactttgaaggacgtacaccacttcattgcgctatacaacataacttcactcagattgctaagtacttattagatcgaggagctgatatagtcgtacccaacacattgattatacatcagtacatacagtaaatagcatagatatggaggaggatacaaatatttcaaataaagttataaggtacaacactgtcaataatatatggaagacattacctaacttctggactggaactataaatccaggcgtggtctcgcataaagatgatatatatgttgtatgcgacatcaaagatgaaaaaaatgttaagacttgtatatttagatataacacgaatacgtataacggatgggaattggttacgacgacagaaagcagattatcagctctgcatactattcttcatgacaataccataatgatgttacattgttatgaatcgtatatgttacaagatacatttaatgtgtacactcgcgaatggaatcatatgtgtcatcaacattcgaatagttatatcatgtacaatatactacccatctactaaatataatagaataaaataaatgagtatgatcattttagataacgattgattttatcattaccgcttcattcttatattctttgcttacggaacctatatttagaaacatctactaacgattttttatgcttgcattattaatggtatgtaatatgattgattgtgtacgcaataccaatttgttaagtatgaatacggggtacaaacataaactgaaatttaacattatttatttatgatatatatcgttatcgttattgtttggtctataccatggatatctttaaagaactaatcttaaaacaccctgatgaaaatgttttgatttctccagtttctattttatctactttatctattctaaatcatggagcagctggttctacagctgaacaactatcaaaatatatagagaatatgaatgagaatacacccgatgataagaaggatgacaataatgacatggacgtagatattccgtattgtgcgacactagctaccgcaaataaaatatacggtagcgatagtatcgagttccacgcctccttcctacaaaaaataaaagacgattttcaaactgtaaactttaataatgctaaccaaacaaaggaactaatcaacgaatgggttaagacgatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagtgttgatatgatggtgggtaccgagaataacttgcaatatgtacatattaatgaattattcggaggattctctattatcgatattccatacgagggaaactctagtatggtaattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtaccgattttagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttatgactaacttttcgatggtatatcgtacgaaggtctacataaaccatccattcatgtacatgattaaagacaacacaggacgtatactttttatagggaaatactgctatccgcaataaatataaacaaatagacttttatcacgtttatctatgtctaaatattacaaatagtaatagtataaactaaagctgataatacttaaaaaaataataatatcatttacaattaatagtataaactaaaaattaaacaaatcgttattataagtaatatcaaaatgatgatatacggattaatagcgtgtcttatattcgtgacttcatccatcgctagtccactttatattcccgttattccacccattacggaagataaatcgttcaatagtgtagaggtattagtttccttgtttagagatgaccaaaaagactatacggtaacttctcagttcaataactacactatcgataccaaagactggactatcggcgtactatccacacctgatggtttggatataccattgactaatataacttattggtcacggtttactataggtcgtgcattgttcaaatcagagtctgaggatattttccaaaagaaaatgagtattctaggtgtttctatagaatgtaagaagtcgtcgacattacttacttttttgaccgtgcgtaaaatgactcgagtatttaataaatttccagatatggcttattatcgaggagactgtttaaaagccgtttatgtaacaatgacttataaaaatactaaaactggagagactgattacacgtacctctctaatggggggttgcctgcatactatcgtaatggggtcgatggttgattattgattagtatattccttattcacacaaaaagaacatttttataaacatgaaaccactgtctaaatgtaattatgatcttgatttatagatgaagatcagcctttagaggattttaaccagtatgtttaatatgaaaaaaataaacataacatattttgagattaagcgctattgtgcttaattattttgctctataaactgaatatatagccacaattattgacgggcttgtttatgaccggcaatcatgaatttacagaaattatctctggctatatatcttactgcgacatgttcgtggtgttatgaaacatgcataagaaaaactgcgttgtatcatgacattcaattggagcatgtagaagacaataaagatagtgtagcgtcgctaccgtacaagtagtcaatcaaagagaacgtagtagattgttggctacatttaattggacagatatagctgagggtgttagaaatgagttcattaaaatatgtgatatcaacggaacatatttatataattatactattgctgttagtataattattgattccacggaagaactaccaacagttactccaattacaacaacatatgaaccttctacatataattatactatcgatgatagcactgttattactactgaagaactacaagtgactcctcatatggatctccatcgatgatacatgtattaaaatactttccgaataagtcttttaaatattgtattaattatgaaaaactatgctatgcgagtatgatgcaaagatgtttaatgatacgatactagattttatctctagcgagagatgtcgttagaatcatttatcataactacgtttaataataattcatcaacgaatatcgataacatgtgtcatttatacgttaaagtctgtccgtcttctctattgtttagactgtttgtagaatgctgtgatataaacaaactagtagaaggtacgactccgttacactgttatctaatgaatgaaggatttgaatcatctgttttaaaaaacctattaaaggagtatgtcatgaatacgtttaatgttcatgacatccattacacaaatatttaactcatgatgaagttgagaatgatatgctttctgatagtatagatagctttagctaatataaaaatatattaatccactatatattctagacttgatttaaaaccgataaactactactacgtactgtataagttgttaaaaaaaggagcagaccctaattatgtagatgatagaggtaatacttttcttcattacttctgcatctatatgtccacttatgagaaaacgtcatttaataagatgcatcgtgaaaagaaatttattaaagagttggtaaaatatgaaaccgaaagtaaataatataggaaatacacctctacataactacgtatctcaatatgatatcactctcattcctcatccacaacccattaaaaaaatggaaattaaagccctctattagcataaacggctacaggtctacctttacaatggcctctccttgtgcccagttcagaccctgtcattgccacgctactaaggactccctgaataccgtggccgacgtcagacattgtctgactgaatacatcctgtgggtttctcatagatggacccatagagaaagcgcagggtctctctacaggcttctcatctctttcagaactgatgcaacggagctctttggtggtgagttgaaggattcacttccgtgggacaatatcgacaattgcgtggagatcattaaatgtttcatcagaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaaatctccttcatgctctctcactacactttttatcatcttatgaggaatgattgccttcatcatttttcgtgaaataggaataattagcaccagaatagctatggattgcacatgtattctatgtcgtctactggatgaagatgtgacgtacaaaaaaataaaactagaaattgaaacgtgtcacaacttatcaaaacatatagatagacgaggaaacaatgcgctacattgttacgtcttcaataaatgcgatacagacattaagattgttcgactgttactctctcgcggagtcgagagactttgtagaaacaacgaaggattaactccgctaggagcatacagtaagcatagatacgtaaaatctcaaattgtgcatctactgatatccagctattcgaattcctctaacgaactcaagtcgaatataaatgatttcgatctgtattcgtatatgtcttcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcaataacaatgtttccatccatggcagagacgaaggaggatctttacccatccaatactactggtcttgctcaaccatagatatagagattgttaaattattaataaaggatgtggacacgtgtagagtatacgacgtcagccctatattagaggcggattatctaaacaagcgatttagagtaaccccatataatgtagacatggaaatcgttaatcttcttattgagagacgtcatactcttgtcgacgtaatgcgtagtattacttcttacgattccagagactataaccactacatcatcgataacattctaaagagatttagacaacaggatgaatccatcgtacaagccatgttgataaactacttacattacggcgatatggtcgttcgatgcatgttagataacggacaacaactatcctctgcacgactactttgttaataataatctcgtcgatgtaaacgtcgtaaggtttatcgtggaaaataatggacacatggctgtaaatcacgtatcgaacaatggccgtctatgtatgtacggtctgatattatcgagatttaataattgcgggtatcactgttatgaaaccatactaatagatgtatttgatatactaagcaagtacatggataatatagatatgatcgataatgagaataaaactctactatattacgcggtcgatgtcaataatatacaatttgcaaagcggttattggaatatggagcgagtgttacaacatcacgctcgataatcaatacggccatccagaaaagtagttacagaagagaaaacaaaacgaggatagttgatttattacttagctaccatcccactctagagactatgattgacgcatttaatagagatatacgctatctatatcctgaaccattattcgcctgtatcagatacgccttaatcctagatgatgattttccttctaaagtaagtatgatatctccggtcgtcataaggaactaaagcgctatagagtagacattaatagaatgaagaatgcctacatatcaggcgtctccatgtttgatatattatttaaacgaagcaaacgccacagattgagatacgcaaagaatccgacatcaaatggtacaaaaaagaactaacgtccatcattacagaaactgtaaagaacaatgagaggatcgactccatagtggacaacattaatacagacgataacttgatttcgaaattacccatggagatactttattactccattaaataatttatcatggagcgataatgtcctgtttcatttgtttccatgacatattacaaaatcgattccgtccaagatgataaaaacatttaccggcatcataaacacggagtttattttatatgtctcgcataaacattactaaaaaaatatattgttctgtttttctttcacatctttaattatgaaaaagtaaatcattatgagatggacgagattgtacgcatcgttcgcgacagtatgtggtacatacctaacgtatttatggacgacggtaagaatgaaggtcacgtttctgtcaacaatgtttgtcatatgtattttacgttctttgatgtggatacatcgtctcatctgtttaagctagttattaaacactgcgatctgaataaacgaggtaactctccattacattgctatacgatgaatacacgatttaatccatctgtattaaagatattgttacaccacggcatgcgtaactttgatagcaaggatgaaaaaggacatattcctctacaccactatctgattcattcactatcaatcgataacaagatctttgatatactaacggacaccattgatgactttagtaaatcatccgatctattgctgtgttatcttagatataaattcaatgggagcttaaactattacgttctgtacaaaggatccgaccctaattgcgtcgacgaggatggactcacttctcttcattactactgtaaacacatatccacgttctacaaaagcaattattacaagttaagtcacactaagatgcgagccgagaagcgattcatctacgcgataatagattatggagcaaacattaacgcggttacacacttaccttcaacagtataccaaacatagtcctcgtgtggtgtatgctcttttatctcgaggagccgatacgaggatacgtaataatcttgattgtacacccatcatggaacgattgtgcaacaggtcatattctcataatgttactcaattggcacgaacaaaaggaagaaggacaacatctactttatctattcataaaacataatcaaggatacactctcaatatactacggtatctactagataggttcgacattcagaaagacgaatactataataccgcctttcaaaattgtaacaacaatgttgcctcatacatcggatacgacatcaaccttccgactaaagacggtattcgacttggtgtttgaaaacagaaacatcatatacaaggcggatgttgtgaatgacatcatccaccacagactgaaagtatctctacctatgattaaatcgttgttctacaagatgtctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgccttaaagagattcgaatctccgacaccgacctgtatacggtatcacagctatcttaaagccatacattcagacagtcacatttcatttcccatgtacgacgatctcaaacccgtacccagaaatacctttaactatatcgatgtggaaattaatctgtatcccgtcaacgacacatcgtgtactcggacgaccactaccggtctcagcgaatccatctcaacgtcggaactaactattactatgaatcataaagactgtaatcccgtctttcgtgatggatacttctccgttcttaataaggtagcaacttcaggattctttacaggagaaaggtgtgcactctgaatttcgagattaaatgcaataacaaagattcttcctccaaacagttaacgaaagcaaagaatgatactatcatgccgcattcggagacagtaactctagcgtcgacatctatatactatatagtaataccaatactcaagactacgaaactgatacaatctcttatcatgtgggtaatgtagccatatgcccggtagttgcgatatacataaactgatcactaattccaaacccacccgctttttatagtaagtttttcacccataaatacaataattaatttctcgtaaaagtagaaaatatattctaatttattgcacggtaaggaagtagaatcataaagaacagtactcaatcaatagcaatcatgaaacaatatatcgtactggcatgcatgtgcctgccagtcttcagcaatcatcctcatcgtgtacggaagaagaaaacaaacatcatatgggaatcgatgttattatcaaagtcacaaagcaagaccaaacaccgaccgatgataagatttgccaatccgtaacggaaattacagagtccgagtcagatccagatcccgaggtggaatcagtcgaggatgtagatcctcctaccacttattactccatcatcggtggaggtctgagaatgaactttggattcaccaaatgtcctcagattaaatccatctcagaatccgctgatggaaagactgtgaggtgtctatcgacatcagatgtagcgaagaagagaaagacagcgacatcaagacccatccagtactcgggtctaacatctctcataagaaagtgagttacgaagatatcatcggttcaacgatcgtcgatacaaaatgtgtcaagaatctagagtttagcgttcgtatcggagacatgtgcaaggaatcatctgaacttgaggtcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaagttacctctcgcgacttcttctttttctgtctcaatagtgtgatacgattatgacactattcctattcctatttcctttcagggtatcacaaaaatattaaacctctttctgatggtctcataaaaaaagttttacaaaaatatttttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaatattaaacctctttctgatggtgtcactaaaatatttttattctcattctcattttctctttctctcttcaatggagtcataaaatatttttattctctttctctcttcgatggtctcacaaaaatattaaacctctttctgatggtgtcactaaaatatttttattctcattctcattttctctttctctcttcaatggagtcataaaatatttttattctctttctctcttcgatggtctcacaaaaatattaaacctctttctgatggagtcgtaaaaaagttttatctctttctctcttcgatggtctcactaaaatattttttattctctttctgatgcatcaactatttcttaaacaataacgtccaacaacatatactcgtcgagcttatcaacatcccctatgcccatctaggttaccagacaattgtatatcataaaataatgtttataatttacacgttaaaatcatataataaaacgtagatcgtataatattttttggtatataaatgatctagtaaaatccatgtaggggatactgctcacattttttctttggtacaaaatttcacacaagtttttatacagacaaattcttgtccatatattttaaaacattgacttttgtactaagaaaaatatctagactaactatctctttctctttctctcttcgatggtctcacaaaaatattaaacctctttctgatggagtcgtaaaaaagttttatctctttctc

SEQ ID NO: 2 - DNA, 138203 bp, Artificial Sequence
  Synthetic Polynucleotide
ccggcgaagccgcggatccgctgttccggcgaaggcaggacagacattttttccagcccataaattaaaaagaatcaacagaaaattatcatgatgataaaaacttttaggattgtatttagttgaacgtttcgtcaataaatcaacctcaaattttttcacatgtaatttcttgttctttttaatttatgggctggaaaaaatgtctgtcctgccttcgccggaacagcggatccgcggcttcgccggggcggcggccggctcccgcggcggctgagccgcgctgccgcgagaacgcggaccaggagttcctgcgggaggagctacggcagaggctggaactgctgaatgctttcgaggacgggcgtccgcgggaacgcgactccgcggaggcggcaccccgcagccgcgagacctcgctctggagtcagggagtcagggagtcgggagtcagggagtcgggagtcagggagtcgggagtcagggagtcgggagtcagggagtcgggagtcagggagtcgggagtcagggagtcgggagtcagggagtcgggagtcagggagtcgggagtcagggagtcgggagtcagggagtcgggagtcagggagtcgggagtcagggagtcgggagtcagggagtcgggagtcagggagtcgggagtcagggagtcgggagtcagggagtcgggagtcagggaaacagaagtcaagtagtcgggtagacaggagtcaggtggtcgggtgaccgcgccgtccgagtcccgcaaaaagtttttagactctgagagaggccgacctgcctccaacggttccgcggaaaagtttttataaaaagttttcgggagaggccgactgccttccaacggttcctcctctcgcgtgccgcgggcggccgctctcccgcgacggtcccgccaacgcgtttacaaagttttaaaagttttcgagagaggccgacctgtcttccaacggttgcgcgaaaaggttctgcggaggtttggaagagccgcccgccctccgacatcctccgaaaagttttcgcaaaaagtttttaaaggtttcgcgaggagttttcgagggaggcgacctgcctccgaggttccgcgtaaacgtttttacaaagcgtcggaggtgggggcgacctgcccttcctctcctccgaaaagctcttgagagtgtgggagaggcggccggccttcgcggtcgcgcgaaaaggttctgcgggagttcgcgggagctgacccgccctccgcgcccctccgaaaagtttttgcacgaagtcttttggcgttctcgagaggacgcctaccccgacggtaacgcggaacgtctcgggaggtcggcctctccgctcccgcggtcgcgggcggcggcccgtctccggaggttccgcgaaaagttttataaaaagttttgagggaggtaccgacctcctaaagttttacagagagttctcgcaaaagttttgggaggtcgacctgacctcctaaagttatcgaagagttctcgcgaagagttctcgcaaagagtttgagaggccgacctgcctccaacggttccgcggaaaagttttataagagttttgagagaggtcgacctaccttccaacggttccgcggaaaagttttataagagttttgagagaggtcgacctactctccgaggttccgcggaaagttttataaaaagtttttacaaagtttttgagggaggtcgacaccctccggatcctccgcctcgcgtgccgcgggcggcctccaagagttttacggaacgttctggagaggagaggccgacctcccaaagattttgcggaacgttttggagaggaggactggcctcgaaaagattttacaaagagtttggagggaggactggcctccaacggttccgcgaaaaagttttgcaagagtttggagagaggtcgaccaccctccgaggttccgcgaaagtgtttgcggagagtccgagagaggcagacactgcctgcgaaaagttttcgcggacggttgagcgggtcaccgacctccgacagtttacaaacgttttacggagagttagagaggcagcagaccgacctccgaacagtttagttttacaaagttttggagggtgaactgtcatcgggaaagttttacgaagagttttgggagaggccgacggttagccgagcgagcgcgcgagcgagtttacgttctctcgctcgtgtgcgcgttaactcgcactggttccctctctaactcggagtgggcgagcgagtggttgactcgtcctccgctctcactctgagtggtgataactgttaaccattaactcgtcctccactctctcactctctcactctgagtgaggattgacttgttaactcgtcctccactctctcgctctctcgctctgagtgagtgaggattaactgttcaactcgtcaactcgtcctctgcctctcatccaagactgagtgggtagttgactgctcttgttctcttactccgaggggtgattgagttagcaacagctactcgttctcttgttctctcacaccgagtgagcgagtgagcaacgttacttgttctctcacaccgagtgagcgagtgagcaacggttaactcgttctctcgttctctcgttctattattccgaggagtggcgagtgaggtaacggttactgttacttgttctctgttcccttcctcggtgagcggtgcgtcaacttgttctcgtgagtgagtacggtcacttgttctctcgttctctacctcgaggagtgagtcaacttgttctcgtgagtgagttgaccgtaaccgttcccttacctcaagtgagtggcggtcgcttgttctcgtgagtgggttaaccgcgttcccttaccggagtgagcgggcgggcgataaaaataatcaattgactgattcgctcgtgagcgagcgaagggcggcggacaagggcgcgggatgctggtctaatctactaaggccgattacaaaaacggatgggagaccgggagggagagggtcacagctccgagcggtgcatccgcgccagctggcggcgccactcggccgcgggccgcgcggccgcccaggccgcgttgtagccgcccgccaccgcgacgcaggtcagctcgaactccggcccgagcgcgcgcacgtcgtagatgtgcacggtcgcgacgttcagcagcagcgcgcccttgcgcagcgaggcgaaggtcgcgtgcatgccggcggcgagcgggtacaccggcgagagcgtcccgccgccgtgcgcgaccaccgccatgtgccgcccgtcgccgccgacggtcaggcaggtcaccgaggcggagccgttcgcgcggacggggcccgcctccacgagggcggccggcagcggcggcgccgcggggcggaagagcccgccgaggaggaagcccagcgccaccagcgcgagcgcgccgagcagcctgcgcggcgaggggtgcatgcttgttggctgcggtgttggcgtctggcgggtggaaggcgggtgtggggtgtccgcggctgcggcgggagggtctcgactgctaggcggtcctttttcactttgctccgtggcgcctggtccggggcaagggctgcggcgggcgcccgggcgggcgggccgctaccccgccgcgcggcccgcggccgccagcgccgcggccagccgccgccaccgcgggcccgccgcgcgcagcagccccgccgccgagcgccccgcgccgccgcgggcgcgcgccgaggccgcggccccgcgccgcgccagcagcagcggcagccgcgcgtccagcgggccgccgcggcgcagcgccgcgcgcagcagcgccgccagcggcagccgccccgccgcgtccgggcccgccgcgcgcgcgcccgccgccagcagcgcgcgcaccagcgccggcgaggggcgccgcgcgcggaccaggtgctccacgagcagggtggtgagcaaggattctcgagaagtaggagtcatgtgtgacgacaaggagagacgttatattaggcgcgtcctacttcactttgaagatggtgtaaagtgttaaaacttgaacaccgttcactccaccactgccgttaccgtgtcctgccccaaaagcaaccacagtgctttttccaccacctgttccaaatccgttccaaaagctcccatccattgttgttagaactttcagatgtttctctaggttgtttagttccactgcaagtttcgaccattatcgttactggacatgctgttggtaatgagtttaataaccaatcataaaaatagttataatttgttataaagctaataaagtagcaaacactttaatgttatattttgcctaaccctccgttaacaccaccattaacaccaccacttaagcttttactaccaccactaccacctccaacacacattcttttctctaaaggtccccaaattccacctcctgaacttggacgttttacagcacctccgggtgtacttgcgtaccctttagaagttccactgtgactgtagatatgatactgtccttctccaggcatgattaaagtgtgttgtaattagtgttatctacgcaactgtgcgagactctcgaataaaaagaagctacattttacaattttgattagctgatgtaccacgctgtatcgcggccaccacaagcacccgatccagtagaaccaaatccagagtcgccgcggtcagtgttgtccaagcagttaacctcttgaactgctgggcacgatatgcgttcgcatattagctgagctatcctgtctcccttcttaacctcaaagtcactgtttccaaagttaaacagcaccactccgacgttgcctcggtagtcttcgtcgatcacgccagcgcccacgtcgataaagtgtttgactgcaaggccagaacgtggtgctatgcgtccgtagcaaccagaagggggctttatcagaaggtcagtaaatactacgcgactgcaatgcgaagggatgacacagtcgtatgcactacataggtctaatcctgcggcaccaggagatcctctggctggtatagtggcgttttggctgaggcgaacaacctgaagagtttccgtgtggcagaactccatggctagggtggcgagcggccgatcgactacggggtgtacaatttacactttctccagaaaaatcaggggcgggtcagcatggcgcggcgcaagtccagcagcgagtcgtacgacaggaagcacaggatggaggtcacgatctccggcggcagggcgcacgggcacatgaggccggcgatctgctcggccagcgagacgcgcagccgcatcatgcagatcttgccgaagagcgccgtcccgtagatggggaactcggccgcgcgctccaaaaaggcgttctgcacgaagagcgccttcgcgtcgtccgacgcgcgcagcacgtccaacagcgtcgcgtccgtgtggcagcgcaccgcgcgcatgcttgcgatctcctgctcgcacgcgcggatcacggtcgcgtagtccgccagcgcgcgctccgccagcatgcgcgcgccctcgccgcgcagcgccagctcctgcacgcacagcagcgcggcctccgagcgtcggaacacgtggccccattgctcggatgtgatcagcgcgcgcgcgagcagctccgtcggcggccggcgcgcgagcacggccgccgtcgcgcgcacgttgttgcggcgcagcatctccgaaaccgcgcataggcccgaggccgacatgtgctcgagctccgcgcccatgcgcaccagccggcagcaggcgccgtggctgaacaccgccgcgcggtgcagcgcggtctgcaggttgttgttgcgcaggttcaggtccagcccgcgctcgagcacgaagtccacgacgccgcgctcgcagctcccgtaggtcgccatgtagtgcagcatggtgttcccacacgcgtctacggcggccgggtccacgcctaggcccgtgagcgtgcgcaccatgccctcggagatcttggccgtgcgcgcgaggtggtgcagcgttgtgcgcccgtacgcgtccacgacgcacgcgtccgcgcccgcgcgcagcatcatgtccacgagcgcggcggagacgccgccggagcacagcagcgccgccagcggcgtcaagccgttgcagtcgcaggcgtttgggttcgcgccgcgctcgagcagcagccgcagcacgtcctcgcggatccactggttcttggcgtacacgtgcagcggcgttacgccgtaggtgttgccctcgttcacgcgcgcgcccgcgtccagcagcagccgcgcgacctcgagctcggcgccgtcggggccgcagaaagccaggaaggaggagagcacgctgtcgcagacaacgacgctggcgtcgcagaccacgtccgcgcccgcctccagcatgagcgcgaccacctccggccgcacgccgtcgtactgcacgtaggcgtgcagcggcgtgcggccgcaggagtccttggctttcacgtccgcaccggcctccagcagcacgcgcacgatctccgcgcactgctcgtgccgcgcgaagtgcacgcagaggtgcagcggcgtgcgcccgtgctcgccgcggaagttcacgtctgcgtcggtggctacgagcgcgcggaccgtttcgaggtccacctgcccggactccaggtagcggaagagcaggtccgcgtgcgggaccacgacggactcccgcgagagcatggcggcgtttacaaatattgaaatcttttttcactcatctttatgggcgctgaacgcgcaataagggtgagagtaaaaaacttctacaaaaagcgtacaaaaggtacaaaaggtaaaaaaggcggggcggggacgggctggggtgctgcgagctgaattggcctctacacagggacgccctcgccggagccggtgagccggtagccggcgccggcgatcatggtcaagcgctgcacgagctcgttgcgcttgacgccggcctctgaaacgcacaccatgtggtggatgtaccgctcgatgcactcgcagcgcgggagagtggagtcaagatcggatgcgagttgcagaatgtcatcccagagctcggagaacttgctgtacagttctcggaggtctctctccattcgagccgtaagagagtcaggatgcggtgttccttcgggagtctgagcgaacaccgcgaacaggctggttatgccgtgttctagaatagagtggttccgcgttaatgccgcagacaagggtcgtcgtccgcgcaacgactggcggcagagcgctgtttgtgccgcaccgcccattcctctggcgatcgcatccaccgacgcagtgatcatctgcgcgccgacgtcattgtagcgcgcgttaaactcagtaatcatgattacgagattgcagatttcatagtagcacttttccaagtcgacgcgcagtttcacgatctggttgacaatcttgcacgcctttcgccgcgtctccgccacgttggcgactcggacttgcgcttcctggtcgatggacggcggaaacacttcaaacccaaggtcgcacagttcagcggtggggactagcgtcacgatgatgtactccgcatcgccacccacttgcggcaggaagaacaccgaccgcgcggcgggaacgaccagaacgtcgccttcctgcatgttggtttttagaaacttagtgttgttcacggagatgccggccatgccctcgtttttgacacatattatggtgacgtacgcggcgaccgtgggggccatgtggtggcgcatgtaccactcgtcgtgcttgagtttcagaccgtgagattcgccaacctcgaagtgcatgttggcgtctctgacgtagcgcgagaactcgctgcgacagattcgcgcgggcgcccggtggaacgtcgactcgaagagactgatggctgtccattcgcccacatgagtgaccaccgaagaagtgttttcgatccgagtctcgaacaccgagtccacgagcaccggacagttggttccgggcaccgtcagcaccaagggccgcgcctccacgggggcgacggacgaagccacggagtcggtgtccccgtacccgtagtcgtcgtcggagtcgccgcctccgtcggccccgtcgcgcggcctccgcagcggcatgcagccggcggtgggaacgcactggtttcggccacggccgaagcggccaaacagtctcgccagggctgacatccttggacggccacaccaaaaccaaaaaaacatattttatcagttatttgtcgattttcaccggctcaccgagggcaggacctcctggatcccggacacccccgccaggcagcgggccgcgcgctcgcgcacccaaaagcggtcgtagccgtgccggagcacgaaggccgccgtggcgtggcagtccacgcgctcgatgaagccgtggacggcgcggcgcgcgtagctcgccgcgaaggcgcggaccaccgccgagcagcgccccgagggcgagtcgtccgtctccagcgccagcggcatgctcgcgatgcgcgacatcaggttggaggtctgcgggatgttgagctcgcgcgtggcggtcatctgcgcctcgagcccggccttgagcacctcgtcgcagcggccccactccagcgcgcagaccacgcggatctcgtaccccttgagccgcagcgcggtctcgatgtccacggaggtgagcaccgcgctgaagcgcaggcgctcttcgtccgcggggtcgaagagcacggggatcttaacctccgcgctgcgcgtgacctcgcagagcgcgatcgcgagcagcccgcgcgtgagcttgctcaccatgcgcggcttgcccacggggtacagctggctcgcgacctcgcgcagcgggtacgccagtcggaagcagcgcgcgtccgcgggcaccgggctcgcgcccgtctcctcgaggaagagcgcggcctcaaccatgttcagcgcggagaagtgcaccgggcaggcggcgcagccgcgcgcggcgttcgcgagcaccatctcgcgcagcccgcggaaggccgccatgtcgcaggaggggaagatgcgcgcgagcgcggcctggtgcgcgagcgccgcgtccgagagcgcctgcgcggccgcggcggcggcctcctcggcggcggccgcgctctcgtccgcggagaccacgtcttcgggcacgtccacgcagacgccgccccagaactcgcagtactcggagaagagcgtcgcgggcgcaaagcgcgcgaggtccacgaaggcgacgcggttgccgagcctggagagcagcgtgttctccgagatgcgcgtccagcccttgccggcgagctccatgacctgccgcgtgtcgaagagggagctgtagaagccgtacacggtgatgttttccttgcacgtcgtcagccacatgaggaagtcgcgcaccaccagcttcgcgcagtctccggagaacacggggccggcgttcgtcgcgatggagttcaggcgcacggtgccgtcactgccgaagcggtacacgaaccaggcggccacgctgttgccagagggcgtgtgaacgtgtggctgcgcccaggagtcggcgctcgcggcggtgcgcacgtcgtgcgagagcacctcggtgtcggggcgcgagtaggtgctggggtctttgatccagatggcgtagctgcccacgcagcacacgttcatgaggtcgagcagcgtctgccggcgcagcggcgtgccgagccggcgcacggcgtcgtgcgagaccatgcgcaggtcgtagaggcccacgtccgagagccactggttgagctcgtccatggacagggcgtcgcgggggggcgggctgtcttcgaaggcggcgcggagctcgggctccgtctccgcgcgctgccgcaggatgtccaggaaggggctggaggagtcggggatgtagcagtcggggtcgtgcctggacactatagcgaaccgctgcgtcgcgggcggcggggctagcgcgtcggcgcgtgcgtcgatgaaggtgcacgatatacgcacggacttgagcgaggggaggacgactgcggcggcgcgcgcgccctccgcgtcgaagatcatcgtctttccgtccctcgcctttgcgagcgcgtattctccaggcacgaggtccgtcggcggcggctcgtcccaggcctgccggtcagggacgccgccgcacacctttccccagaaccccagcatcctccaaaatacctataaggacggccaatagcggggcttgcgggcgttcggaccttccgcgctttaattttaatttattggcttgcagaactccgagcgccagtcccgctcgaagaccgcggacaggtccttgacgatgtcgcccttctcggcgttcacgctcacgaaggcgtggtagcggtagtgcgtgccgtcgaggttggcgaccgtgaggtgcgcgaaggtgtcgtccacgatgagcagcttagtgttgttcgcggcgtcgtcccggccgggtaccacgaacttgcgcacggacatgtccacgctgccgacgccaaagtcgtcgaggctgcgcgcggccgagaccgaaagcgggtccgcgttcttccactcggtaatgatcacgcgcacgcgcacgccgcggttgatggccgcgcgcagcagcgcgtcaatgatctgcggccagtactccacggcgctggcgtgcttgatcaccggcaccatcgagagcagcgagaggtcgatgctgttcttggcgttctcgatgcggtgcagcacgaggtcctcgtcgagcgtgcggtagaagcctaggaagcgctccggcgagtccgagaagaatacgccgcccccggagtggtcgaggtggaagttcgtggccgtgggcgtgacgatggcgcagcagagccgcgtgaacggcaccttcggctccacgatcatggagtagaaggtgttgtagcggttcatgaggtcccaggccaggtgcttgttggtggagtagagcccgaggttcttgatggtggacacggacccgcccgtgagcgaggcgcttcccacgtaccagtgcccggcgtccgagagccagaagctgccgagaaggttgccgacgccctccttggtggacaccttgaccttgtagtagttgacgcccgcctcgcgcagctcgtccgcgtccttgtccttgctctgcacgtccacgagcagcgtgacgtctacgccctccttggcgagcgtgcagagcttgtccttgacgtcgacgccctccttggtggagctcaggttgcagcagaagctgcagatgtacaagaacttcttcgcggactcggcgatagcggtgaagcagtcgagggtgctcatgttgccctgcgccaaagacgccacctctgcgggcagcgtctccacgacgcggcagtcggcgcccagggggatggaggagaacggccacatttatttatctcacaaaaataatagggcttcagggaaagtcttttagcaggcgggcgagttcttcgagttcgcttaggagttcttccatttcttcggaagtcagcaactggagctcggacttgatttgaatatcttcgaggaaaccgtctagcatgttcgccatgtcttccggggagcactgcgccacatcttcggggacaggatcgggtgtgggcattaggtctccgcttacttgaacgtcgtccatcatcctgtcgatgaggtcttcgacttctagacggggtccgtagatcagcatatttggtgatggaggtagtttaaggtgcgagagttagtgttatacgaccgccaacgtgtgtttatcgcgcgtacattttcaataattaacaaactccccttcctgcgcctgctcgagaagcagctcgtccagctcctcctgtcggcgcgcggccacgcgtctttccgcgaagagtaccatcagctccagccccacgccgcacagacccaggacgccgaacaccaccgccgccgagatcgacagacccagcagcaccgacatcctcacgcgggcatccggctatttaatcgttctggaaacgtattaatatgggcgtcgtcatgtgcgggtgtctgtttgtgtgggcgggctggatcgcgcgccgcgtgcgcggcctctgcgcggcgctgcgccagagggtgtcgcgcgacaagggctacgtggccgtcatccagacctgcgacgacgactacttcacagaggaggagttcgacgacggcaagcaggtggtcgcgctcctgcgcgacgtctcgcgcgtggttgccgcgcccgcgggcgtgacggaataagttaggataaggagtcgaggggagaaaaacagcggtcacactataaactcgcgcgaggccgattttgacgtgctcatgtctggaagctccgctttctgcagcgcggagcggcacacgaagcacacttccgtgttggtgggagttatgcagtggacgtggtagccgtgcccgcacaccatgacttggaacggacacgcgccgggacaggccgcgtttatgcatccttccggcgagcgcttgttgcagatgtagcacacgtctgagcacgccagcgtgcaggacacggccagcttccactgcttaaccttaacgggcatggctagttgaacacgaccatgggcgagtcgcgagcctcgagtcgggggttcagggcaaaccgtttcacgccgtcaacggttcttctctttgcaattttctctctgcacaggctcgtcagcgtcatctcggccaggcgcgcgtcgttgcctaggtgccgcgcggcgtcctcgaccgtcacgcccgtcttgccggcctcgtccatgagcacaatgcataccaggtgcgcgctagagcatatgacctcctgctcgcgcccgccggcagcggggatggttagctccgcgcgcccgaaggccgccagcggcgccacgtcgtaggcagtgtctgctcgggcgagcgccgactccacggcaccgcggagcgactccggcggcgtcagcgcggccagcggcaccggcgtgggcacggtgtacacgttcacgggcatgagcaccatctccgggtcgtggtggccgctctcttcgccgtcgtgctccatgggctgcggcggcggcagcagcgggagcagcagccgtccggacatgagccggcgcacaaggtcgttgagcgcggacgaggccatcggcgggtacagctccatggccagcttcagcgataggtgcttctcgaggttgacgccggtgtagacgctcttcacgatgcgcgcgaaggccacgcgcgcgaaggccgccagctcctcgcgcggcaggcgctcgatgtaggagagcagcatgtcggtgtcgcacggcggcgccgcgaccaccgcgccgtagagcgccttgcccgagagcttttccagcgcccttgcgtgcaggccgtgggtcttgagcacgtccacgtagttcacgtacaggcagagcgcgcgatcgaggttgctctccgcgacgtgcgtctcgatgcactccacgatgagcgggcccatgcggtccttgatgaggtctatgagcccgccgtaggcgactcgcgcgctcatgaggcacgtgcggcagtacgccatcaggccctcgaggtccgcggctatcacgtcctcgaccacgttcgccacgacgcgctgccagagccgcaccttgctcacgttctggtgccgcaccatgtccacgagctcgtcgtacgagccgccgggctcgtgcgcgcgatcgacgatgcacctcgccatggtgcggctctggcgcatgagctcgttcgtgaagcgcacgcacgcgtcctcggagaagagcgcgctcaggcaggagtagcagcggtccgcgacgaggtgcgggaagcggcactccacgacgccgcggccgatccgcagcacgcactcgccgtacatctcgtccatggcctcgcgcagacagtcgtccagcacgtccgcgttgtgcgcccactggatcacgcagaggtagggctcgatgttctcgcgcgcgttttccacctcctgcaccatgtactcgagcacggtcatgtcctcgtggatgtcggtgcccagcatgcgcccgggcggcagccagctcttgcgcgcgatcgcctctcgcaggcacgccaccgccgtgaaggtgttgacgcggagcttggtcagcagccgccgcagtcgggagatgtgtgccacggagaggtccatctccatggcctgggcgatgaggcgcgtgagttcctcctccatggcggcggctccgcgggcagatatacgcgaacaacggtaagccgtgctatttcatttttggacaaaaagctagtcgtcgacgcgcatgttgtcgaggttccggcacagcgagagcacgtcgtcgcgcgcgcgcctccggcgcagttgattgttcgcgcgccgcgcgtccgcgagcgcctgtctgtacatcgcggagtccgcgtacccgtgcagcggcgagcgccgagcgccgggcctcgggctcgcgcggcgcgggagcggcgttggcgcgcgcctcgagcgccgcgcgaagtgcgcctgcatggccagcaggcaaccgaacggcaccatgtatcggtccatgaggcactggctggccgcggacggctcgcgcgggtgcatcacgccgccgcccacgtcctccatgacgtcgcgcagcacgcagcgcagcatggtctccatgccgtccacgggcttgaaccgcaccggggaggcgtcgacgtagaagccgtcggccacgaagtagagcgcgtccagcccgccgagtttctcgccgagaccgacgaagagctcgtccacgtgccagtccaccaccgaggccttgaagagcaccacgtgccggatgtcgtgcgagcgcgcgagctcccaggtgtcctcgccgatgttgctggcgtcgatgcggcctgtcatgcgcacgctcacgcacggcgtcatcccgttcttgtagcagaactggcgcgcgagctcctcctggcgtacgatgtcgaccatgctctccatgaaggaggtggagagcagcatcgcgccgcgcgcggcgcgggtcgcgttttcgtccacctccacttccatcccgccgccgatcctaatcatctatcgtatttaaattttcggcggagcagacacgcggctgctcgctgcgcgatcgcttcagccgcggcggcgtcacgcacgcgttgcggcggccggcacgcacggacgaccgccggggctcttcgctgagcgagcgccgcggccgcgtgacgcgacagtcgcaggtgggttgccgggagtcgctcgcgcgccttcttcgcatttcgccggaacgccgcgtttatgtaggggattatattttcaacgtaactaaatggacgggggcgtgcacaaacggcctttcatcgtgaacgtggatggcatgggcaaggtgctcgtgctccggtacttgcggatgtgcgaggtgcccgaggccaagtgcgagggctcgcgcgcgtcctgcgtgctcaagatggaccctccccgctcacccagctgcgagcgcaggccgtctctcccgccgtcccccccatgccccatgcgcacgcctcccgggtcgccgctccaggctcccttgatgcgcacgcagatgctccaggggctgttcgacgctgccaaaaacaacggcgagcagatgtgccgccgccagtaacctaggctgcgcagtacgaaagttagtgcgtgatcacgttttttgcaatgtcgatcacgccgtgcgtgcccgtcttgcgctcgcgctccaccacgctagtcacgggccgcgcgtccgagactagcgaccccagcatcgagcgcacggcgccctccgcggcggggtggcgcgtcagcagcaggaacatcacgatgtgcgcggagacgccgcgccggctcagatcgtgcacggcgtcgccgtccatgagcacggtgttcgagaagtacgtgaacagagtgttgtctcgcaccaggaaggccgagttcgagacgctctcgaagtccacgatctcgtcgtcctgcacgcccatgtccaacagcgtctgcacgagcgcgggctcgtccaggaacaccactgcgcgcgcgaacccgcagtccagcgcgcgcgcgtccgcctccaacacgcgcgaggcgccgccctccggcggcaggaaggcgcagggcagcggcgtgcgtccgtccgccggcgcctccccgagctcctcgagcgcgaaggccagcagcgtctccatgcgcgcgcgcgccttgtcgaagttgtccgcgaggtcgcggatgcggtctgtctgcgagaacatcttcagcatcgccatgagctgcacgaaggggtgcagcacgtatatgttgtccacgagcagcgtgggcagcgcgcgcagcgtggcctgccgcacgttgaagctgtccaggatgtgcccgccctcctcgtcctgcagcaccacgtagttcttcaggtagggcacgcgcagcagcacggtctgccgccccgtgacgaagtatatcaggaaggcgaggttgatcaggaacgggcgcgcgttcgtctgcaccatgtcgatgtcgccgtactctatctcggggttcagcaggtgcagggcgtacgagccgtagcacacgcaccgcttgttgtgtcggcgcaggtgctccttcacgagccgcttgaccacctccaccaggtccgagtgcttgtgccgcgccatcggcgcggcctcctcgggcggcggcagcactgcgtacgagttgagcgcgcggctggcgagcgcgcgcgcgcggggcgcgtccacgcgccgcaccgccgcgttgattgcaggcgtcggcgtcgtgagagagcccagcgtgcgcgtgaactcgctcacgatcacgctctgcagctccagcaccgtcaggatctggcccagcttctccaggcgccgctgcctcgagaagtactcctcgatgcgcgcggcgatctccttctcggagccgcctagcttcttgaagaagcgacgacgactctttacaacaagagagagaaaaagcttcctatcgaagttgaggacgcgggtcatgttgcggcgctgcgcgcgcaggagcacgcagcgctccatggaggggcgcgagccgaggtactcttcgatcacgggtggagccatgacagctattttctgaacccgcgattattgtacagcgcaagccgcgcgcagacctgctggcacagcagcgtcgtgtttcgcatgcacacgcgcgaggactcgatcgtgcgcgcgtccggtgcccaggcgcgcagctccatcagttcctgctcgacgaagtccacgggctccacgaagcgctctgcgcagagtccgtccgtgaacgcgttgacgatctgccgcacgagcactaccacgtccacctgctccacgaggcgcacgcccatggcgacgtgcacgaagaggcagcggaagagcgcgtccatggccatctggtggtccgagcagggcccgaccgcggtcttgcagcccagcgcgaagcgcccgatgccgcggtactgcaccatctccgagggcgagaaggagagccgctccatcttgagcacgggcggcgggcccgccggcagtccgcgcgcgaggtccagcaccggcgtccacccgggcgtgaacatgtccgggatcaggaagagcccgtagctggccatgcgcgcgatgtcgaaggcgtggtccacgaccttgttcacggcgctgtccgcgcggtttacgcgcagcgcctgcaggatcacgtttccggaagcgtgccgcgtgatcgcgaggtccgcggtcgcgtacccgcgcaggcccggcaccgcgtacgcggtcagacacacggccaggcgcgcgctgtgctccgaggagaagatctcctgctcgtagccctcctcgggctcctcgcactcgcgagggcgccgcacgtcctcgaccgagcgcagccgcatctctccctccgacaccagacagccaagcgactccctcaccgccggcgcgagcacctccgtggcgcagagcgcgtcgtgcacgcgcttgagtgtgttcggcttcagcgcgtagccgaagagcagccgcgtcatccgcgagcccgagaacgcgaagcggcgcacgtactcctccgcgagctcggggcggtcgttgatccacgaggtagagaagacgtggtcggaggcgaaggggtctgcaccaaccgcgagcagtgtggacagaggtacggtgtcgaggaagtccacgacgtcggggaagttctggcgcacgcaggcctcggcgacgcgtctggtgtgcacgcacatgtcggtgacgggcacccggtggccggactccacgacggacacgcagacgtcctcggtgacggcgtccacgggcatggtccgcagcagcttgccgagcacgtcgccgaacccgccctcgagcgccttgcgccacacgaaccccgcgtcgaacttcccggggaagtccgcgatcaccgaaagctccgcgtgcgagaggttgtccacgttgaggtaggtggcggcgtccacgaagatgggcccgaaggcgccggtgtcggagacgcggtctctgaggtagtccctggcgtagtggaggtactcccgcacctggccggcgcggatgcgctcgagcgcgaaggccttcatggtctcggagcagagcacggagtgccgcagcccgtccagtgtgcgccgcacgtcgtagacgccgcgcatctgcgcgagcatctcgacggcgtccgccggcgtcgccgccgcgagccccgggttcactggaggtatcctgtgttctgcgagcatgcgcttgaggaaacagaggtccagcggccgcgtggtgtacagcgcggaggccatctcggggcgcgtctcgacgatgtcctcgatcatctcgtccgtgaatgccgcgttgatgttgtgcacgctgcgcgcgttcacgtgcaggaggatgtcgcccacgttgtcggggaatcgctcctcgatgagccggacgtcgtcctccgtgatgttcatgtagggaatacagcggcagagcagcgcgtagtccgcgaactgcgcgatgtagggcgtgtggaactcgatgtgtctggcgaagagcgcgccgcagcgccgccgcgagagctcttcgagcaggtcctcgggcgtgacgtgctgcgggcggaagaggtgcaggtgcgtggggtgctcggcggccacgcgcgcgtacagccgccgcgggaggtgtctggggtgcacgccggcgagcacgagatccatggcctctgaggtagacagtgcggcgaacgcgcgctcggtgccgcccgcggcgacagcggcgccgacaaatctcttgagcagctgcagcatcgcgtgtttgggctttcgcggaaggcgcttattttaatgttattggcggtggccggtgcgagataaaaattagaactgatgccgcagttgttgatgatatgatgattgcgctggccggcgcgagataaaaattagaagctgatgccgcagttgttgatgaggatggtgagtgcgctggagcaagcggtgtggcgcgctagcttcttgctggccccgtcggccacggcaacgacctttccggatatcgtgatggtgcaggtgaagcgcggacagtgatcctctccgccagcacgcgtctcgcagaactccagaggtctgtgtgtcatcatgcagaactcgttgaccgcgctgaccgggttaagacttttgaggcgtatcacggcagactgagtcatgatgtcgatgtcgccgccgaaaagcgtatcgcacccagcctcggtctccatgggctcggtgtcggagttttcgtcctcctcggtgggcgcggagggcgcgcactctacgaaccagcggggcgggtttccgtcctcacagcaaacctcgtccgagtccagcaggcggtacagctggcggtttgcctcgtgtttggatatgccgagctccttcgcgatttgcttggccggcagcttgtcgtcggattttctgagaagctcgaggatcagagacgcgcactcgcaggccattgtggcgatttacggggcgtgcgtttttttaggattttggcttgcctttcttttcgcagaacttgggaggattgaaactcttttggcaatttttgcaggcgtacttgatcaagggcggctcgtccgccgagcgcgtctggatcatcatcggcatggtgttcttgctctggcacgaggggcagggcaggttgaacttctcgtcgagcacgttgaagtacccgctgtagtcgtggtccggcacctcctcgatgtcgtagggcacgcgcgcggccacgcacttgaccgcgaagagcaggtaccgcagcgcgtcgtgctccgcgccgctggtcgcgcggatctgcgcgcacaggtccgcgtagtcctcgttcgcgtccacctccaggctgcgcttgttcttgtacgagagccggttcttggcgtccttcgagtactcgatgccgatgttgtgcgcggggtcaaagttggtctcgtcggtgttcgaggtcttggtgttcacgatgttcttcagcgcgaagcgctgcgcgcagtccagcgcccatcgcgcgatgcgcgcggcctccgccgcgtcggtgtgcttcgccgcgaggtcgcgcagccggtcttcgtccatcgcccgattttaggttgggtatattatctcaattccgctcttccgcgggccgcgggcgcgcgcccgcggcaaattaggcgttacaaatggacttcgtgcggcggaagtacatgatacacgccatcgaccgcaacctcgacttcatgaaggccgaggtccagcagaaggtctccatcttctccctcgggcacgtgctcgcgctccactacctggtcaccgcctttccgcaggcggtcatcaccaaggacgtgctcgcgagcacaaacttcttcgtgttcgtgcacatgtcgcagcggcacgaggtcttcgacgccgtgctcaaggcggccttcgacgcgcctcagctctttgtgcgggcgctctcgcggcacttcgaggccttcgttgccgccatccgggcctaccgcgcgacctgcgcggagctgctggccgacgcgcgcttcatggaggtggctgcgcgcgcggccgagctcgcggaggtcattggcgtgaaccacgacatcgccgcgaacccgctcttcgcggacggcgagcccgtgcgcgacgcggagctcattttcgcaaagaccttccgcaagaccgagttccgcgccgtcaagcgcctcgccgtgctgcggctgctggtctgggccttcctcgtgaagaaggaccttggcggcgagtacgcggacaacgaccgccaggacctgtttacgctgctgcagaaggccgcggggcccgtgcgccacagcgcgctcacagagagcatccgcgagtacctcttccccggagacaggcccagccactgggtctggctgaacgcgcgcgtggccgacgacgcagaggtgtaccgcgaccggcccgcgcgcacgctctacgagcgcgtgctcagctacgcgtactcagaggtcaagcaggggcgcgtgaacgccaacacgctcaagctcgtgtaccggctcgaggacgaccccgacatcaagggtctgctgctgcagctcatctacgacgtgcccgcggacatcgtcggcgtcgtggactccgcgaacgaggagtggcggagctacttcgtgagtctgtaccgcgagaacttcgtcgacggacgcaccttcacctcggacgcgcgcttccgcgacgacctcttccgcgtggtcgccgccgtcgatcccgacttcttcgagcccgagcgcatccgcgaggccttcagcgcagacgcgcggctgcgagagcgcttcacggacatggacctcaacaacgccttcatgtcgcacctcatctacgactccgtggaccccgacgtcgccgccgccgagcgcgggctcgcactgcgcgtgcacaacgaggactccgactacttcatccgggagtacaacacctacctcttcctcagcgagaaggacccgctggtgctggaccgcggggcgctcacgcggctctcggacgtccccgccgagcgcttccgcgacctcttcagcgacagtgtgctgcggtacttcctggacgcgaagctgggcacgctcgggctggtgctcgaggactaccgcgaggacgtggtcgccgccatgcttcggcacctgcgccgcgtcgaggacgtgtcttccttcgtgacgtacgccgcgcgcaagaaccccgcctgcgttcccggcgtcgtgcgcgcggtcgtgagcaacttcaaccccgcggtggtcgcggccatgcgccccttcctgcgcgagcacatgacgcgcgtggacgcgctgctggacggaatgccgcacctctcggaggccgaccgtcggtacatccgccgcgtggtgctgcagggccgcgcctgattcgccgtcaataaatcgcgatggtggacagcggcacgcacgacgtggactccgccgcgcaggagcgcacgcccaaccagcagaccttcttcaccaaggggctcagtccgctgatgcgccacacctacatctacaacaactacgcctacggctggattcccgagaccgcgctctggagcagccgtctgggcgactaccgcgtcacggacttctacccgatctcgctgggcatgctcaagaagttcgagttcatgttctcgctgctggcggaccccggcggcgcctgccccgcgtacgagcccaagctcaacaccgagttcctgaaccgcggctccttctcgggacggtacgtgaaccccttccaccgcttcgcggcgctgcccgagcgcgagtacatatccttcctgctgctgagctcggtgcccatcttcaacatcctcttctggtttaagggcgagaccttcgacactgccaagcacagcctgctcggcgccgtgtacaccacgcccgagcggcacatcgagctcgcgcggtacctgcggcgcacgggcgactacaagccgctgttcagccgcctgggcaacgacgacacctactcgaagcccttctctgggttcacgcgcatcagcaaccccacgcccatcgggcggctgccgccctcggacttcgagacgctggccaacctgagcaccattctctactacacgcgctacgacccggtgctctgtttcctggtcttctacgtgccggggctctccgcgaccacgaagatcacgcccggcgtggagttcctcatggagaagctctcgctcgcgcccgagaacgtggtgctgctgtagcctcaaacataaaatataggcgcctttgatcgcactgcttcagttcagacagagctaagatggcttcctacatcagcggcgctagcgccagcgcgaacaccgcccagggcggcgattctcagtacccacagtactattatcacacacgcacctcccaaggcgacatccgcgacgaaagcgaaggttgcttccacaccacggacgacgagcacttggatctgtccgacgactacctcggcgatggcgcaccacactgcggacacagccacaaccacagtcgcagagatggagatcggcaccgccagcgcgcaccgcggctctatgaggacccggtgcccgcgaacatcatggtgcccacgctcagtctagagcagctgctggaggaaacctcggtcgcggggggccttctcggcggcaggacagagagggacgtggaacagctcctggaggagttctccgcactctgtcccggggaccagatcaccgcgctgcgctgcatggcggcctccttttaccgcgacgcgctgttcgcgccgtacgcctgcatgcacctcatcgccagtcggatgcgcgtgcactacgcgcgcgaggtcgtgcacgtggccgaggacctcgcggacgcgatgtctgcgaacagcggcgtctgcttccggcggtaccgaaagcgcgtgctagaggacatgctcgcggaggagatgggcgtgtacaattacctcgcgcgcgccaacgcggacatctgcgaggacaacctgctatcggccgtggagacgctgctgcggcgcttccgtcggatgggctgctaccgctctctgtgcatgctcaagatcctcgcgctgcagcacgaggacctggccggcttcatccgccgcagcataagaaaaacctgcaacttggcacacgcgcgcacgcacacggtttacgtgtagttaccctgtaaagacgggcttgctcccgaacaagcgctcgaagaagagcgtgcacatagccttattgtccagcaagttgactatctctgtacacagcctcttgaagtacacctcgtacatgatccgctcgtttttatccagtctgaaggtcttgtcgaccacgcgctcgtaggacttcacgttcgcgatccggcgccgccaggggccctcctcgcacacgtacgcgaagaagtagcgctcgccgatctcgatggcctccgcgttcgccgcgttgtaccgcgtcactagcgccacgttggggttgtcgggggacttgaagttcttgtggtgcgttcggctcagcaggaaccagtccagcggcatgctgcgcgcctcgaactcgaaggtgagctcgtcctccagcgagcgcaggatctccacgcccacgttcccggagccctcctccgccagcgcgcggcagagcatgtccttgtacttgcggatcatgagcttgtggaagggcgccacgtcgcggcgcgtctcgctggtgcccttgctcacgcgctcgctgccgccgccgtcgctcaccgcaaacttgatcgtggtgtacttcttcttggactgcatgatcaggttgcagtacaccgcttcgaactccaccttgaagttcgcgaagagcacgtgctcgttgatcacgcgctccagacagcgccccacgcgccgcgagaacgcgatgtcggaggcgcccacctccaggaacacggagtcggtgtcgccgtacacgctgcggaagcccacgcgctccgtgcgctcgccggccaccgccgcgtcgatctctagctccgcggcgcggcccgcgaaggcctcgtcgcgcagcagcgggttgtccggcgccgccgccagcgacagccgcgtgccgcacaccgacgcgccgtctagcgtgcgctccaggtacgcgatcatggtgcgcccgatggccgtgcagctcttggccgaggcgtacgagaagagcgcgctgttgcggaagcccatgagcccgtacacggagttggccgtgatcttgtacgtgtactgcatcgagttgtagatctcgcggtccaccgcggtctccgcggccttcatcagcttcttgtacttggcgcgcgcgtccaggaaggagcgcagcagcatcgggatgatgcccttggcctcgcggtcgaagatggccacctcggcgacgagctccggcgagcgcggctcgcagggcaccgcgatgtaccgcggcgccgggaacatccgccggacgtccacggccgcgacctccgcgtcgagccggttgtccgagacgaccacgccgacaagcgtctccggcgacaggttcgcgtagatgcacacgttcgggtacaggctgttgtagtcgaagatgagcacgtgcttgttgtgcatcttctgcttgggcgccatcacgcggccgccctcgtagaagaacttggacttcgtgtccgcgcgcaccatcaccgtgcggttctccagcagcagcttcatcagcgggcccttgatgcaggtgctcgcgcggtactcgaagaccacgctctgcggcagcaggtacgtggacgcggcggccgcgatcttggtctccacgccgtagtgcgaccagaggtagaggcagaggcaggcgtcgtgcaggcagtaccgcgccatgtccagacacacgtccagcgagtagttcgcgtacatgtccgcgaggctgacgtcgtccttgccgaaggccagcgtgacgcggtcgccgggcgcgcgcgccgcggggtccgcgaggtccacggtgaagccgtcctcgtcgacgcgtttgtgcagcacgcggcacacgcgctcgtccacggtcacgtagttgccggtgctgagcacgcgagcgaacacggccgcgttcccgtcggcgtcggtgctgcggtcgccgcgaaagcggaccgcgtccggccgcgcgtcctccacgaccgcggtgcagtggaaggcgttcttggatatggcgtccagcttgtaggagtccagcttctcggtgcgctggatgaaggcgtacaggtcgaagtagatggtcccgttgttgttgttgatgtggaaggtggtgctcgagacgccgccgacgcccttgtggctggacttcgtgcgctcgtacacgcagaagttgactgtctcggtcccgtccggcagccggaagcggatgtgctcgcccgtgagcagcgacagccgcgagtccaggtaccgcaggtcgaagttgtggccgttgaaggtgaccacgaagtccagcggcatctcgagcaggcgcttggccacgcgcagcagcgtcacctcgggacacagcgtgacctccgcgtcgaacttcacgtccgccgggtccaggcagaccgggatctcgcgccgtgccgcctcctcgaggtccgcgtcggagagcatatcggagttcgtaagcgtgaatcgccgctccgcgccgtccttgtccaccacgcagaagctgatgtgcgagacggcgttcttgaagacggaaggaaactttttctcgaagtggcactctatgtcgaggaagagccccgagcgcgtcacgttgaagcgcgggatcttctccgcgaagcacgcgccggggtcgtcgcagtggaagcagttgctccccaggtcgcgcagcagcgcggggtccacgcggtagcacccgtcagggtcgatgtcgtgcgccacgaagaaccaggacacgttcagaaagtcggacatgaagacctctggcggcgcgagcttgcgctcgctggccaccagacacagctctatctccgagcgctggcgctccggaatcttcgccgagcgcgctacgatctcgtcgatgctgaccacggacatgggcccgagcgcgcgcgtccacgccagcggctgggcgatgtcggccaccgcgtccgcgcgcaccacgtagtaaaagtgctgcacgaagcgcaggtacacgacggcgttgtcggcgcggcgcgccttgaggaagaggaaccggctgtcattgccgcggttctcgaaccagttcaaacatttcagctccatttcaaagagcataataacatttcatttaaatggagcctcgcttctggggccgcgccatgtgggcggtgatcttcatcgtgctgcggcgcttcgaggagcaccgcgacctcgagcgctgcaagcggcagctgtacgtgatctgctccacgctgccctgcatcgcgtgccgacgacacgccaccgccgccatcgagaaaaacaacgtcctctccagcgaggaccccaactacgtgctcttcttcttcatcaagctcttcaacaacctcgccttcgacgacagatacaagatcgaccccgcgaaggtgcgcccgctcgtctagagcatgccctcgtacgcgcgcgagttgtccgagtacacggtcaccgcgatgccctcgcgcggcgtcacgtgcacgtgcatggagtccgtgatcacgaagcccacgcccgtgaccggctcctcgcccgcgtcgtccgtgaagagcagcccgtggttgaagaggtagaactcgttctctgcgagcgaaagccgcccgcggtcgcagaggtagtagaagatgtcgtagtcgcgcacggccagcgtgaacgtggactcgctcaccacgatgtacttgtccagctcctccagcacggacgcggccgcgcggcgcgcggtggcgcggcactgcgtcgggcactcgcacgtgtctgcagagtacaggatgcgcgttcgccccgaggcggtctcgagaaaaacgttaatcgcctccatcgcccagaagcgactcgaggatcgcgagcaccgtgcgcagcacgagcccgatggtgcagaagggaacctctcccgactccgagcactcgcggatctccgtctccacgcggtcgtgcacttttatggagggagccgtcgttccagtggcctccatcgcgacggacaccaccttggccacgaactcgcggatcttgctcatgcgccggagcacggtcacgcggaagaagacggccgcgagcaggtactcggccacgcagctcacggcgatgagcgcctgcgcgtgcctggtgttgagcacgtgcgcgtcgggcacgaagtccgagatcttcaggtgcgagagccgcacgagcgcgttggtgtccttgacgccgtcgcaggaaatgttcgcgaagatgagcttctcgtagtcgagcgcctcgaccacgcgctgcgcgtccatgtgccgctcgcccgagagcgcgcggctcaaagggccccagcacaccgagcccgcgaagcaggggtccaccacgccgtgcatcgccagcagcgtcacgtcggccaccgccgcgaggatggccgcgtcgtcgagctcgttcgcgggcgtcgcgcccgtcagggacgcgctgcgcagcgcggacccgcccggcgccgcgtgccgcgcgcagaactcgcacccgcagcccggcggcagcggcggcttcgagagcagacttatgagcccgcccacgtgcccgtgctcggtgatcagaagcgccaggatgctgtcggtgctgccctctatggcggctgtggccgcgctagaaggctctcccgtgacctgccatccgcagacaaccttgagcatcttgcgcttgagctcgttgggcgcctccgaggccagcatcgtgcgcgggaacgtcgcgttgaggcggaagtcctgcagcagcttttcgagcgtcgcggtcttggcgtgccgccctttgcgccactcctcccccaggtgccacatgagctcctcggccgtgtccagcgtcggcgagacgcgggccttgggcacgcgcgccgcgctgcgcatcagcggctccgaggcgcggaagctgccgcgcgcgtgcaggcgcatggacgcagacgaggaccgcatcgagggtctctggtggaagctcgtcatcgtgaagcgccgcgtgagcggacctacctcgtcgcgcgactcgtcgaagtccgggtcagggtccgtcgtgtcggtctcggcgctgtgcgtgctgggcgcgctgctgcgggcgctgcgcgtgctgcgcgtgctgcgggtgctctgcgtgctgaagctgcgcgagcaggagtccgccgtgtccgcttcctcgtagtggaagtccacgtgctcctccggcagccggcgcgagcgcgacttggagatgccgaccatcttgtccgcgccgaccgggcgcacgcagagcgccatcgcgccctcgcgcaccgcctgcgcgaactcgcggctggcaaccatgctggggttgaggaacttgatgatgttgaagtatggccactcgcagacgagccgcgcgcaggtcgcgacgtcgtcgacgcttctgagggccctgttcagcggggggatgttgctgccgtcggccagtgcgacgaggtcctcgggggagatctcgagcttgggaatcatctcgttcacgagcgcggggtcgatggcgtggcagacggtctctacctcggtgcgcgagagcttgagctgcgcgcaggccgcccacggcgcgcacgtgagcgcgaacaccgcggagactcggcccttgccgaccatcgccacaacctcgggctcgtagaccaggccggccttgagcagagcctcgagcacctctatgtcgtcggcggcgagcagcgcgcgcctgtggaagcacaccgcgggcatcatcttcttgcagatgccgcgggtgctcttgagggccgtgataaggtcggggagcctgacgtgctgcggctggaagaacatgacgttggcggggctcgcggccaccgcctcgtcgtacaccgacatcggcaggtcgccgtggagcccgcacggcagcaggctcagcagctgcgcgcgcgagagcttctcggcgcagaagttcttcttggccagggcggccgccgcgtcgcgggccttcttggggtataacaacatggcgggctttaaacacgaaacaaaaatccgggttgtaacatttcaattttgcatgttctgggcctcctcgcagagtttctccaggccgccggccacgatggcgtcgacgaagaggtcggcctcggtgaagcggtggttgccgcgcaccgccaccagcgcgttctcggtgaccaccaccgacagctgctgcgcagccgtgcgcaggtcgaagtgtcggcacgcgagcccgtggcccagagtctggtccagcgccgcgagcacctcctccaggctctcctcgcggtggttgtagaaccacatcagcacgaagtaggccacgtaggtgtagaggtagtgcgcgaccgcgcgggcgcgcaccagcggctggttgcagcgcgcgaaggccattccgctggcgatgaggtcgtcgtccagcgtggcgtagtcgccccagttgagcgcgctgaactgcacgctgtagaccgcgcgcacgaacccggactcgaggatgtcgatctgcgacggcgcgccccaggtcaccagccggtacacgatgccgcgctgcatcagccgcatgaggtcgccgccgacctcgcgcaggcggtgcgtcagcgaggcgaaggccagcttccgctgcgtgtactgcaggcccacggccacgcacccgtccgactccaccagcacgagcttgtggtccgtgcagccgtcgctgcgcaggccgccctcgcgcgccatcatgtcggtgacgaacatgtacttgcgcgcgcgcggcccgaccaggatgcgcttcttgccttccatgcgcagcaccacgtcctctagcagccgcgtgctgtccacgcgctccacctgcgggtggatggtgggctggtagttgtacagcagccgcggggaccagttgtaggcgaacgcgaagaggtgcgtgtccaggagagagatggggaagacgccgccttcggtggcgcgccggaggatggcgagcttggtctccgcgggcagcaggctcccggtcaccgcgccgaagaacatggggtggttgcggaacttgagcgcgtacgcgctcagcacctcctctcgcgagaatatcgagtccgcggggttggagctcgcgggcaggagcacgtcctccacgctcagcacctcgtcgatgaagggcagcaccatgtccacgttggaggcggtgaaccactccatgtccacggcgttgcgctccacgatcacccggatcgtctcctcggatatgttctcggcgaaggcgctctgcagctcgatcaggttctcggtggcgtcgatgctgagcccgaggcgcatgccctgttgcagcacgtcgttgatggggttcacgtacatggccaccgccatgcacccggccggctgcacgcgccagaggttggagtacgcggacacgtccgtgatgcgcagcgtctccagcacgttgtacatcgccgcgcgcatttccagcgtgtccacgtacacctccgcgtgctcgaagatgatgtcgagctcgaacgcggacagcggcagactcacgtagatctggcaggcgtcaaagagttcctgcgcgtactcagagaagcacgcgtacgcgatcacgcccgcgcggttgacgatgtagtccgccttgaacatcttcgtgaggtaggcgtacagcgaccggcaggccacgtgcggccttagctcgtcgagcacggcgtccagcacctcgcggtgctgcagcacggaggggtgcaggaactgcgtgaagtccaccgcggtctcatccatgaagtcggggatggtctcgaccaccaagcggtggttccgcaccgcgcggaagccggtgttcatcggcgcgatgctgtgctggtcgtggacctccagcaggatctcgtagccgatctctcggcagctcagcgccgcgcgcgcctccgtcacgctcgcgttccggaagaactgccgcaggtgctcgtccgtgcggcagagcgtgacggattgggggatgcgggaaaggtcgcaaagagggctgtggacggagatgcgccgcagcgcgtggtctacgaactcaaaaccgcgcctcgacatcgtgaagtcgcggagggcgtacatgttgtaggaacagaggcggaagaggcagtctatgtctagcatgttggaaacgcagtacgcgtgtctgtggaggtgcgggagcatggcgggcacgacctcggtcgtgttctggagcatggtgcatacgaggtcgggcgctgtgaggtcgggggtgacgatgaggatgcaggagctggagaacttgctgagctcggaggccagccggtgaaggttgtagtcgtggcgctggctgaagttgctgtttatcgtgcccgtgaagcccatgagcgccgccagcgtcaggtcctcgcgctcgatggcccagatgtctaggccggaggctatcatgcagcgcaccagcgcggcggcgcggtcgctcgtggggtagctcatggtgctgtcggtcgtgcgaatcagcatgggataatgcttcatttttacggtcgggggttgcggactgtggggcgcacagggcctgcgggcggctcgtgccggtccgcggcgttcgccgaacgcaggaacgggcccatgcgcgcccaggccatccacagccccgccgtcagcgccagcagccagacgaataccacgatcatcttttatgtagctggaactcgcgctcactccccgccgcacggcgacggggagagcccagagccgagctccatgcgcgtgctctgcacggtgagcgactccacgagcttggacacgttcatgcgcgtgttgtcgggcaccaggtgcgcgaggcgcgcgtacacgtcatcgtgcatgcgcttgctgcagcggtccaggctcgcggagagcgcggagactagcgcggtgtgcttcgcgtacacgaagtcgccgagacacacggtctcgagcccgagcacgtcggcgctctccgcgtccttgagcgccacgaatatcttctgctcctcgcgcgtcatcgagcgcatgaggtagtcgtgcagccgcgagcgcgagatgagcccctgagagatctgcgggctgcgcatgaagcgccggcgcatcgcgcacagcagctcctcgtcgacgacgtacatgctgtccttgatggagctcttctcgtcgatcacgagcagaccgtcgttggcgaccacgttgatgaaatcgtccacgtgccgcgcgtctatgtcgtagcgcgtgccgccgcactcgatgtgcgagggcggcgacttgagccggttcgcgagcgccttcacgtcggagacgtcgatgtacagcgaggactcgcgcgggacgcagccgaggatgcgcgtctcgagcggcgtgaggatgagcacgcgctcggcgccgtcgacgagcttgccgtcgtcgggggaaaagaagttgttctccacgatgctcgagacgaggctggcgagcacgccgtcgcggtaggcgccgagcgcaaactcctgcacaaagggcgcgtgcagcaagtccacgggaatgcgcatctccacgcggcgcgcgaccgacttcttcttctgcaggtgccgccggtccaccatctcgtccacgatgtccgatatgcgggagcagaggtacgccttgaggacgttggcgtttaccttgttgaagatgagccgttcgtcctccatttaagctgctcagacgagctttaaatagtggaaacacagcagcacgccgatcgccgccgctatcaggccgattagaaaaacggtggtccaggggacgcccttgggcctatcgcacgccggcttttcggtcattacggtgcgcacgatgtttaggaactcctcgaagtcctcgtccgagttggagaggaaggagccgaagacgccggtgtacagtttgtccatttactactagatattaaacggcgcttccaactcctcgtcctcgaagcccgcgccaggctcgacgacgcccaggccgcgcacgtcctgctcctcgttgaacgtggtctgagtctcgctcatgcgcacacacgtctgctcgccctcgagaccgagcacggtcagcgagcactcgcgcggcatggtgatcttcttaaccgcgaaggtgactttgccctcgccgcccgagcggtagaacaccaccggcgccaggatgagcgtcgccatctgcgcgtcgcgggttgcgaggttttctatctctcgcgtcagcggacatatctgcggctgggtgtcgtcgtcgctggtgaactccaggagagcgccggtcaggcggttgagatacagacatccggacttaaaggtgttgtcgatggccgtttcggtgttgaagttgcgcagcgacggcggaacgcgagcgccggttttgatgttgtcgtatatgttctccagcagctggtagagcagcggactggcgctcacgggcttgaggcgaccgaagtacccgctgtcgttctgccgctgcatgtcggtcttcttgctcgggtagatcttaaactcgcccttcacgacgatgagcggcgagacgagcttggatgctagactttcgacgagacacacgttgatgttggagcagctcgggtactgcgacggagttagagtcacggcctcgatgaccttggtttggctcgacgagagcgacttagcgaagttgatcgcgtcggtgcacgacatcgcctggttctcgccgaaccgcctggcggacgctgcatcctcctgctgaggagcgcggttagacgcgacggtggttttggatacagcgcgtttcattattgcggcgattttaaagtacgtgtatactttcagttttgtcgccgagcgttcagcgcctgcatgcagaggaagtacaggatgatggtgcacgggatcgtggtcagcagcgatacgaagtccatcactgtgaggacgcgcagcgccccgcgcgagcggatgcccagcgagggcgcgccgcggcgcgcgatggtggccccgttcgtcaccactaccagcagcattaggatggtcgcgcccacggcgacgcccaggtcccgcgactccatttatagtacagtatagagcgaccgcgtcacgaactctcggctggccaacacgcgtccgtcgggcgggtgtccgccggccttcccgcggaactccgggacctcgaagctggacttcgtcacgcggtacgtgtacttgccgcgccagaccaggttttccttctggaagacgccgtccatggtcacgcccgccatgaaggcgtccttgacgatgaccagcaccgcgtctagcttgcgcccgttgatgtgcgtgacgaagtccgtgccgctgcggctcgcgcagcggatgtccacgcccgagggcaggtccaccacgaacacgaagcgcttcggcgcgtagagcaccaggtccgaggacggcgacgccgaaggcgccgaggggaactgccggtggtcaaaagggtgcaccacgcccacgatggacgtgacgcggtcgtccgggaactgcgtcgcggcgccgccgccgcggtgccgcgtgaccgtgcttctgcccacgtcgtcgcagaccacgtgcagctccgacacgatcggcagcagcgtggccagcatgcggtcggtctctgtgcgcgtcgcgcagcggtacgcgatcccgcagtgcgcgtcctgcgtgcgcccgaagaagagcaccagcacgctcgcgtcctggtcgaagggacacacggccatcacgcccaccggcggcggcccgtggcctgcgtacgcggaggagaactcctgcacctcgaccacggcgtcctcgcgcgcctcgccgggcaccatcgccgccgccggccgcagcgcccgcacggtctgcttaaccgcacgcgcggcggaggccgcgctcggcgcgactacgcgcacggccgcgtgcgcgcccggcggcggcgcggttccggccatccagcccaccggcgagaagaacacgtcgcagacgtgcacgcccgcggcctgcagcgcgcgcgcgagcgcgcgcacggcctcccactcctcgcgaaaggcgctcgcgaccgcgagcgccttcagcaccgtgtccacggagttgacgggcttctggaagaggttctcgttgttgtagatgaactcggggagctccacgggcactgtgaacagcctaatctcgtgcgcgccgctgggcgtgagccgcgtcgcgggcttgcgcacgccggcgccgatctgcttgaagaagtggttcatggcgccgccggcttctcgggctccggcgggagcagactatttattcgggaggttatcctttccgaaagcacctgcacggacttccgcgtccagcgctccatcttcatgtactccttcatgccgtcgctgagcacctcgacggcctccagcttgggcgctgtcgggtcgaagaggatgctcttgagcagcgtcatcttcttgtccgcgaggaagcggaagtaagtgtagatgcagcgcagcgcgcggaagttctccgggtgcttgatggtgcacaggatcatgaagatgcaggtgaacatgccgcactcggactccatgagctggttgacctcgaggttgatgcagccgcgccgcgccttgaagttgtccacgaagaagcgcatgagcacgtccacgtcgcagttgcggttgtccaggtccgcggtctcggcgttcacgttgaagccgtccgagaaggagtagaagtagaagtacttgcaggggtggaactccgaggggctgttgccgccggagtcgtagaaggacacgagccgcgagacggtgtcgaagatgcagcacttccagtggaacatgtagcagaagccgaacatcacgtagcgccgcccggcgcgctcgatcttgtccttgagcgtgaggctgaccatgttgcagcggaagcggtccgccttttcgtggatggccgcgccgttgaggaagttcaggttgaactggcccaggtacgcgacctcggtgccgaacgcgaagggcgccaccagactctggatgctcacgttgctcatccaggcgctgcggtcgggctttatggcgatgggcactaccttggtgttcacgcccgtgctgacgcccgcgcgcgcgaggtcgtccacgttcagcggcatctgcgagaagtccacggcctcggacaccttctcgcgcaacgagggcttgaagaagaagcccagcgggaccttccactccagcgcgatcgcctcgcggaagccgtagcgacccttgaggctggccagcaacgcggtcttctgcgcgacctcgtccttctcggtgtccggcggcgcggcgtcgatgagcccgcgcttcgcgaagtccagcagcgccgccagcgggatgcacgagacgcgaccggccgtcgcggattcgtcgaagcgccgcaccacgtacccgttgcagttggtcttgaagttggacacgtccaggtgcgcgctgagccccaccaccgagtagatgtggcacagaaggttggtgaaccccagctccgggattttgctcaccactaaatccgtgtacttgtccatttatcatggagaatcatctgccggacatgctgatgtttcccaactgcgtttctgtgtttccctttgagtactcgctggaggacgtgttccgcctccccgaggagcgacggcgcgcgttcgccatggccgtgttcccgctctccaagcaccgctggaggggcgcgcggctccagcgcgacgagcgaagcgtgtggctcagcgtcgaggaggaccgcgggcgcgcgctggacgagcggaactgctcctggctctcggacgtggccgcgcgcatggtcgacgacgagggccgcgcggtcacgcccgaggcgtacgccttcatgcgcgccgcgcccggcgcgcgcgtcgccgagctcgccgcggacgcgggcgtgctagcgggccttgtcgccggcggcaacgcgctgcgcgtcttctcctcggagtccacgcaggcgcgcgagggctggaaggcgcgcagcgtgggcgtgctcggcaacgcggcgccgctggcgcccgtgccgctggcatcgctgcgtccggaagtgcagcgcgagctcttcgccgcctggatcggccgccgccccgtggtgctcacgggcggcacgggcgtggggaagacctcgcaggttcccaagctgctgatgtggttcaactacctcttcggcggcttcgagcgcctggacgccgtccgcgagttcgcggagcgcccgctcgtgctctcgctgccgcgcgtcacgctggtgcgcgcgcacaccgcgacctacctcgcctcgctgggcttcggctcggccgacggctccccggtctcgccgcggtacggcgccatcccggacgccgagcggaacacggccccgcgcgcctacgggctcgtggtggccactcaccggctcacactgactgccatccgccgctacgacacggtcgtagtggacgagatccacgagcacgaccagatgggcgacatcgtggtcgcggtcgcgcggaaactgggctcgaacatgcgatcgctggtgcttatgacggccacgctcgaggacgaccgcgcgcgcctggaggagttcctggaccggcccgcctttgtgcacatagagggcgacacgctcttccccatccgcgaggtctacgtgaagaacacgcaacagccgccgctctcgcgcaagtacgcggaggcggagctgcagaacgtggcgcaggcgctgggcaccttcgtccccgagcagggaaagtgcggcatcctcttcgtagccacggtggcgcagtgcgcgctcttcgcggagaccatcgaggccaagcaccccgggctgctggtgcgcgtggtgcacggaaaggtgccctccgtggccgcggtgctcgaggaggtatacgccgcggaccggcccgcggtgctggtttccacgccgtacctggagtccagcgtgaccgtgcgcaccgccacgcacgtctacgacactgggcgcgtgtacgtgcccgagcccttcggcggccgcgagaccttcgtctccaagtccatgtacacgcagcgcaagggccgcgtgggccgcgtggcgcccggcacctacgtgcgcttcttcgacacgcggctcgcgctgccgctgaagcgcatcgactccgagttcctgcacccgtacgtgctttacgcgcgcatcttcgggctaacgctgcccgacgacctgctcgtgcagcccagcgacctcgcgctgctgcgccgcaccgaggagtacgtcgacggcttcggcatcagcctctcgcgctggacgcagctgctggaccggcactacatgcacatggtcgagtacgcgaaggtgtacgtgcgcggcgggcgcctcgccgccgcgctggacgccttcgagcgcaccggcgtgatgacgcacgaggccaccgaggccatccgcgccgtggacatgctcgcggccgtcctaaacgtgcgcaagtccaaggaccgctaccgcgcggagtgcaaggtgctcttcgggcccttcgcgggcaaaaagttcgtggtcgccgggcggcgtccgcccggctcgcacgtgctcatggtcacagaccgcgtcttcatcgaggccgagcccccattctgaggaccaccttcttggagacgcccgagaagtcgtcggcgacgccgcggcgcgccaccacaaggcagtacgaggtcacgtgcgggcagcgcgcgatgcagcggaaggcttcctcctgcgacagcgagaaggcgaacacgtagaaggtgtgcggggacttcagcggcgtgtggtccatcgagtagatgacaccgagcttcttcatgcgccacataagcgcgttgatgtggtcggcgcgcagcgcgcggcccttgagcacgccgcagacgaagctcgagcaggccacgacgtcgtagcgcgtgttcctgccgaagaccaggtgcggcgcgccggcggcgcgccgcgcggccgcgcgattctccacgatgtcctctatggagcgctcgctcgcaaagaagtccaggaacatgtactggtaggccacggccgggcgcgacttgctgaacttcatgaaggcgtccgagtccatgatggcgtccatgtcctcagcggcgagccggtgctgcagccggatgccctcgaaggtgtggaagagccgcgcgtccgcgtgcatggacagcgcgagagtgacgaagttgagaaggtccgcgtcgccaaagcgcacgagcacgttaccgggcgtgcgcgtcttgcgcatgagccgcgcgggcgcgccgtcgttgtggctgcggcggcgcattttgtcgccgggggactcgggcggcaggtcgatcatgaccagccggtgccgctgcgcgtcctcggcgttgaagatcgaggacgtgaagcccgggtacagcaccacgcagtcgcgctccgagatggcgtgcagcacgtcgcgcttgagcccggccaccagccgctccgcgttctcgacgaagtagttctcgtagtccaggatgtcgtgcgccatccaggggaagttcaggtacgcgttcatggcgtagtcctcggcgtcgaagcagatgcgcgtgtctggcgtcgccgcgatcggaaggtccttgatgccgcggagcagcccgtcgtagtcggactcgtccacgaaggagagcaccacaaagaggtcctcgcccacggtttcgtagtcgaagaggtggtaaagctctcttagcgccagcacggcgagcgcgttgtccagcgaggcgtgcacgcgcgccaggatgctgtagaagggcgtggccatcatcacggccttgccgccctcgcaggcaacggcgcgcgggaaaatgacctccggcgtgcgcggcagccgcccgaacgtcgcgttcagcagcgcgaccgtggccgcgtcgctctggcgcaggaacactaccaccgaggggcccgagatgctgagcatgcgctcgcgcatgcgcgctggcaggtccggcgtggtcacgaggtccgcgaagcggccgccgttgtagaggtcgccgccgccgaggaaggtgagcacgtcgaagcagtgcagcacctcgttgcggaagtagtactcgttctcgagctccttggcgtacgcgcgtatgtccacgttctcgaagtttgttcgcagaccgccgccgtcgaagaaccaggacgcgagctcgcggacggcgtccgcgggcctgttgcggcggctcttgcaccagaagctcatgtagttgcgcgaggtggaggcgttcgccaggaagaagcggtggtcgaaggagatgagcacatgctcgagcaggtgcgcgagccccaggaccgcgcccacgtcgcgcccaaaaccgaagtttgatatccccaggtagacgtcccgtttcatagacggcctcaggaacaccctgacgccgttttccaacactatcattctccggtatttacttacccaaaagtagtatggggagaagtgtttgaacgtcccctcgcctttttaaatcaaaagtagacttctcgcgcccgtgcgccaccgtcacgcgcgcgcggcgcgagtccataccggcgatcaccgcgctgctctgcggtgcgtccggccgcgggaagagcacggtctcggagatcccgtccagctgcgcgtcggtgcgctgccgccacgcgtgcgcgtccgcgagctcgcgcacggccagctgcatcttgttcgtcggcaggaacgtgaacacgtacgccgccgccaggaaggctgcgaagagcacgaactcaaccgcccatgacatttagggagctgattttgttccacgcggcgacgcacgtcgtgacgggcgaccccgaggcgccgcggcgcgcggcctcgctgtgccgcggcttcggcgtggacttccgcgcgattcacgcggagttcgcgcggcggtacccgcgcaccgcggccgccgtggagcgcgcgcagccgctgcccgaagtcgatgccgcctttccgccggacgcgcgccggcaagtcgtgcggctgcgcctcgaggctgcggcgctggtcgtcaaggagtcgcgtgcgctatcggcctccatgcgcggcgtggcggtggtcgacggctgctgcgtgcgcgtgtgccgcgccaacgacgagctgctagagttcctcgcgcggcgctacgaccccgcggtctaccgctacgcggaggtgccctcgccgagcgtgcgcccgggctcgaaagtcttcgcgtgcgcgggccgcagcgtcacctttgcggccgcgcaccggagccgcatcacggccaaccgcccgctgcgcgtggtcgtgaccgaggcctgtgtggacggcgtgctcgcgcgcggcgccgcggaggtcttcgaccgcggctccggcgtgctgccccgcgcgctgcgcgagatcttctaccgcctcgacgaggacggctgtcccacgggccagacgccaggcttcgcggacagtatggcgtcgcgcagctgatctatgtccacctttttctcgtcgatctgcgccacgaccacgaaactgcgaatgtccacagcggccatggtcttggccaccgggtcgtacttgaggagcagcacgtactcgttgccgaagtgctcggtgacctcggtgatgagccggtacacgcccatgccgagcacgttcaccgcaccgtccttggcgaagagcgagaggatgttcacgcacttcagctccatctcgccctcgaggcgcgcgagcatgcgccgggtgacctcgcatactgaacaaagaggcttacctagtaagataagcgttagcttagccgcggtcggtgacgcgtcggaggccatttatggggatcaaaaacttaaaggcgttgctgctcagccacggcgcgctgaccccgcacgagccgggcggcgacgagcgcttccctgccgtgttcgtggacggcttcagcgtcatgatgaccatggcgtactcgtgcgcggacgaagacgagttccgcgcggccgtcgaggagcgcgtgcagcactggatgagcgtgtccgagagcgggcggatcgtggtcttcctcgaccgcggcgagattccgatcaagcagccgctgcgcgaccagcgccgcaaagccacgcgcgaccgcgccgcgcgccaccgcgagttcatcgccgccgcggaggcagacgcggcggcagaggccgttggcgcccgcgaggacaaacaggaggacgagcacgcggagttcgccgaggagatccgcgctgagaagcagctaaagctgcagcgcatccgcttccagctcagcatcgccaaccacgaggtcgttaagtcgctgatagagtccacgctcgcgcgcgctggcgatgccgtggagatcgtcttctgcgacggcgtcgacgcggagatggtcatgtgcgcgcgcggacgcgccgaggccgagcgtcgcgggcgctggccgctgctcgtgaccacggaccaggacgcgcttttgttcacgtccaccgatcgcgacgagaagatagtgagcaccgtctccgcctgctacgcgttcaggcccaccgagacgaccgagtacctgtgcaaacttgcggcgctggccaacggctgcgacttcttccccgggctcggcggcatatgcgtgagtgtggagtcgctgcgccgcgccacgcttttcccggaattctccgtgcgcaacgccgccgtgagtctgtgcacgcggcccatgcggctgtccacgcaggacgcgctggagccagaggccgccgccgaggtcgtggaattcatcaggcggtacgccgccggcgacgagcgcatctaccgcgaggtgccgcccggcgcgtgctgcggacgcgcgtttgtgcgcggagcgctcgcggccgagtgggccgacgcgctgccggcggccacgggtctgagcgtggtcgcggacatgatcgcgtgtctgcccgcgcggcgggaccccgcgcccgaggaggtagagcggctgctggcgctggaggcgcgcgcgcgaggcgcgcgcgtcacggatgcgatgctcgcgcagactgcgcagctgctgggttacggcgcgagtgcgggcgccgacggcgcctccgccttcgcggtctcgggcgccaagggcctgatgtgtcgcctgcgcggcacggccatgttcttcaacgcggagtacgtggaaattgaaagcgaacccagactgttaaagctgcggtagcatggtgttcccgatcgtgtgctcaacgtgcggccgcgacctgtcgcacgagcggtttctgctcatcgtgcgacagcggccgctaaaggttgttttgcggacggtgcgcaacgtctgctgccgtataaagttgtctacacaaatagagccgcaccggaacctgacggtgctgcccatgctcgacataagctgatttttcttttccgctcgtatgcgcgagttcggactcgcggcgcgcatggcccgcgccatcgaggacgtgtgtccgcgcggcgcggtgatattcgtatccagcgccgcgtccatgaccgactgcctgaacccgtcggtgttcaagcacgcggcgatatacgcggggcgcgtggaccgcgcgccgctgccgccgccctcgccggtcccggcggaggccgtgacggagccctgtgcgatagacgccatagcgccttacggcgcgcgcgtggtcctgctctcggagctgctgcggagctgcgtggccgttcaggcctaccgcctggcagtccccggcgccctcgcgctcatgaacctcgcggccgacgcggccttcgagctcgtgggcacgccctacggctttaacagcgaccgaacgtactgcttcaagctcgttgccgactgctttgctagcgtgggcgtgacaacgaagaccaggcgcatcatgggtcgcgacgtcgtgctcagccaggacttcctggagagcggcatgtggaccaaggtgctggactccgccgcggagccgccgtggctggtctagaacagcggcggcgcgcgggtcccgagcacgggccgcgccacctgcagccgctgctgcagcgcgcggcactgcgcctcggcgtcggccgtctcggcggggtcgacgggcgtcggagttgcggaggtggtcctgaacggctgcgtgttcaccgagacgcggatgcgctccttgcaggagcgctgctcgatgcagttggccagcatcttcatcacgtgcaggtactccagcaacacgaacttttcgagggtgatgccgtcgaagggcgacgaccccaccacgcccagcgggctggacaccgcgccgtcgagcacctcgccgcgggactccttgcgcgcgcgctcgagcaggtcctctgtccgagccaccacactgccgaagtcggcggccgcgggggcgggaacaggcgcagcagcgctgtccgcgtccgccggcatctcctcgatcttgagaccggccgcgaactccgaggccgcgtgcacgggcgaggcgccgcgccgcaccatgaagtcgcacagacgcgatagcgcggaggagcgcaccggcatgtcgagcaggcgctcggcctccatctcggcgaccgagtcggcgcacgcgtccggcgcgcccgcccgcacgagctcgtcgcagcaccccgcctccttcatgagcgcgggcatgagcttgtactgcgccatgttcaccagcccgtacttgagctcgagcaggtccgcgagctcggaggccatgggtcggtttttggtgtagatgacgcgctccacggcctccgccatgtccacggcctgcatgagctcgccgacgagcacgctggccacgagcgtggccagcgtgacgcgcacggtgggcacgcagaccgcgaagaaggaggtggagtgggtgaagcgcatgagcgcgccgtgcagacgcgcgaggtccgcgctgttgcccgcgtgcacgaagcgccggcgcagccgcgccagcgcctccacaaggtcctctcgcgtggtcacgcgcacgttcgcgatgcacaggtcgtggatcgcgttggcgatctgcgcgcggcgctgcggcgagctgccgggcagcagccgcgccttggcctcgacgtcgacggtgctcgagagacagccgcaggcggcgccgcggacgacgaacttcaacaacgactcgaacacgcgcgcgcccgcgcggggcgcttgcttggacgactccatttactttaaataatttacgagatcaaaataaaatgactctgcgcatcaaactcgagaagctcaagcagatcgtaacttacttctcggagttcagcgaggaggtctcggtgaacgtggacgtcggcgatggcctcatgtacatattcgcggcgctgggcgggtccgtgaacatctggaccatcgtgccgctcagcgcgagcgtggtatacgacggcgatgtcagccgcgtgttcaacctgcccgtgctcaaggtgaaggcctgtctgtgcagcttccaccccgactcggtggtgagcctggagcccgacctcgaggacaacgtggtgcggctctcgagccaccacgtggtcagcgtggactgcgacaacgagcccgtggcgcaccgcacgaacaccgccatctgcctgggcattaaccagcgcaagtcctacgtgttcaacttccggcgctacgaggagaagtgctgcggccgcaccatcgtcaacctggacctgctgctggggttcatcaagtgcatccaccagtaccagtacatcacggtctgcttccgcgacaagaagatggtgctgcacacgcccgggaaggtggacaacttcttccgcgagtactccatgaccgagtgggcgcccgacctcgagcgcttctcgttcaagatccccatctcctccgtgaacaaactccgcggcttcaagaagcgcgtggtcatgttcgagtcgcgcgtggtcatggacgccgacgacaacatcatcggcatgctcttcaccgaccgcgtgggcatgtaccgcgtgaacgtgttcatgtcctttcaggaccggtctctttcatgcgactaaatactcatgggcgggtcggtgagcctgccctcgcgggacctgccgccgccggtgcgcacgccggagatgaacatcgtgcccgagcgcgacctcgcggacacgatggcgcgcctctccaccgcagacccgccgcagccgctgggcgtcggcgacgacgcgcgcatggccgtgctgaagacgaccttccccgagttcgcgatatcgcggcccgcgacgggcatgctcgccgcgcagcgaatcaggtacgacggcgacccgcgcgtctgctgcggcgggttcgggatctcgcattactgggagaagggggcgcgccgatcgaacgtcgcgttcgagggcgcggcgctgcgcacctgcgaccccacgcgcttcgacgcgggcgcgtgcgacgcgctgctcttccgcgagtgcgccgccggcggcgtcgacgcggacttctgcgcgcactggatcaacgcggccgtgacgcggcgcacggaccgacagtcgcgcgcgcggctgaacgacatgttcgtgcgcgattgccaaaacgacgccgcccggcctcactgcgtggcctggatccgcgcgatgcgaagcgcgcgcgcgacggcggacgacggtctaatagacgccgtgctctcggtgcagagtcccgagttcaagggcaagcacatgcgctgcagctacccctcgccggccactctcgccatggccgcgaacgtggacgagccgcgcgagtgctgggaccccgagtgcgtggccgggaacgtggacttcatgctaagcgataactacacgaacctgggcttgtgtcggctctcgcgctgctccatcggcgtcacacacctgcggattgacgcgcgttcgcggctgcgcatgcggtgcgccggcgcgcttgccgggctcacgaaggcgcccgtgaaccagactgtcgtcgtcggcgacaacctcgcgcgcgccttcgagccgcgcgtggaaacgctcagcgtgttggcgctgtgcgtggtgtatctgctaattgtctggctctaaatgggggccgccgccagcattcagaccaccgtgaccaccgtcagcgagcgcatccgcaacgagctcgagcagagcgcgagcgctagcgcgaccgccgactgcgacgtcaccatcgggagtctgattatccgcaagaacctaggatgcagcgtttccgtccggaacatgtgctcggccaacgccggcgcgcagctggacgccgtcatgaaggccgtgagcagcaccttcaacgacctctcgtcggaccagaaggcctacgtgcccgggctgctcacggccgcgctcaacatccagaccacggtgaacaccgccgtcaaggacttcgagacgtacatgaagcagacctgcacggcggacgcggtcgttcacaacaaaatcaagatccaaaacatcgtcatggaagagtgcgcctctctgccagggagtccggccacgcacctggatttcgtgaacaccggcacggccgtgggcaactgcggcgtgaaggccgtgatggacgtgctcgcgaaggccagcaccaccgtgcgcaacgaccaggaggccggcaagggctaccagaccatcatcatcgcgatcgtggtcgccatcctggcggccatcttcgcctggtacgcgcggcacatgctattcatgtccacctccgacaaaatcaagctcgagctcgccaagaagcccgtggtgcactggaccacctacctggacaccttctttacggaatttccgccgtccgtctagatacgcgcaacattgaaacattatatccacctctcaaacggcggtatggtccgacgcgtcctcctcgagcgcgtggacggcatcgtcgagcactcgcgcgcagaccgacgctacttggaggccattcagcgacacctcgaggggtctacgcccgggctgcggcagatgtggcgcttcctctacgacctgctgctgacggtgttcgtcgtcatgtacatcgtcttccgcctaatcgtgcgcaaccccggcatctgcgccatcctcgcgctcgcggccgcggtgtactacctgtttttgtgtctctttagcatggactgatggcgatcacagacagaccatcgcccgcgcgcgcgtgaccagctccggcgccgcgaagacgtcctgcaccgggaagtcgtcgatctcgaacacggagccgtccgcggaccagatcacgcgcacgttgtcgctcaccgagacctcggtcagcgtcacgcccagcacaaccgcgtcgttggtgctcaccagcaccagcgcgccgggctccgcgcgccggtgcagcggcggccccgagactgagcgccgctgcacgcggaacatgtccgcgaactgcttcgagagcaagtccaggtggttgcggatgatccactcgaagaagtacgcgcaaccgccgccgccgcacaggaagcgcgaacccgcgggcatcagcagccgcacaacgtccatgtagcaggcctgcggcaggctcgcgcggtacagccgcgtcttcggcgagagcaccaccaggctggaggtgctcatctggaagaccagctggctaacggagacggtgagcgtgcacgcgggcacggaaaccacgtccaggcagatgtcgtccagaaagatgctccgctggtagaggtggtacaggatggccacgatctgaaaggccgtggcgtcgctgatggcgcaggggcggtcggcgcagcgcatctgcgcgcaggaccagcccccgaaggactcgaagcagacggtgagcatgcccgtgctcggacagtgtggcgagcgccgacacaccggaaagcccacggccttgcggcagcgcaccatggtcgagagctctatccagcagcctgcctcctcctcgcccatgcccatggctaccggcgtgaaggccgtgacgtcgtcgcagatgcgccgctccagaaaccccacgcccgaggaggggtgcgcggccggcggcgaggtgatgcgcgccgggacgcggctcggagcgggctcgggaggcgagctgcgctcgacccgggcagtcgccgccggccgcgatgccctgcgcgcgggcgcgcgctcgcgcaacttgtttgacttgctggcctcgtcgctagcgtcatcgaagcggtcgttcctgtcgccgcggacgtccgcctcgtcgcccgtcggctgcgcggcgggcgacgtgccgtcccgcgtacggcccgcgttcggcgcgaatgtcacgcgccggtgcacgtacggctccgtagagcccgtgggggcgccgcgcccgcgcccgcggcggaaggcctgccgggacgcgccgaagcgggcgaactcccccttcgcccggccccttttttcttccatgatatttatcacaaaaaaaacttctctaaatgaccaatctgctttcgttggtcgacccggaggacctggccttctgcgccgggttcccgtccttcgacgagaccatgctcgtgatcgcgggggcgcgagtgcgcttcccacgctcgctgctctcgctcttcaacgtggtgccgcgcaccatgacgcgctacgaaaccgagctcgtgggcaccgagatggtggtgggcgccgtgttcaccaccgcgtacaacgtccgccgcaacctaggcctcggcgaggagcccgtgaccatgcgcgacatcgagaagtacttcctggactccgagaacgaggtgctcacgctcatcgtgcacaacaccgacttttccgccatgagcggcgtgcgccggcgcggcggccggcgcatcgccaaccccgtcatcttccgcagcgggtccacgccgctgctcatcgtgatggagtcgcgcaagaagaccaacatctaccgcgagcgcaccgcggagcaggccaacgcctcctacagggaggtcggctcctcgctcgcgctggtcactcggtacgcgggtctgcagctggttgacgtgcacacgcccagctccgtgctaacggtctccgccgtctacggcttcaccgaggacaaggggctcaagaagctgggctccgacaaggagctcgcggactaccagtccacgccgctcaccgaccccatccggctcagcgacttctccaatatattcgacggcgtcaagaagagcatccagctcacgaacgtgcccgtgccctccaccggcgccgaggccgcgccgtaggctttcatgcgcgataaatcggatggcggcgccgacgacgcccgcggtgcacctcacgccggtgttcgtggagcctacgatcgcgcactcgctgctgcgcgcagagtcctacctcgcgatcgcggtccttgagctcgtgctcgcgctcgcgctcgcgctcgtcttcttccgcgacgagctaggctcgctattccgctgcgcgccgcgagcgccttcgccgctggacgcgtacctgcaggcgagcctcgtctgcgacggcgacgcgctgctgatcgagctgcccgagggccgggtgccggcgctcgcgctggacgggcggcccgtcgcgttcccggggtgcgagagccttttgtaccgcataaatggaccacgaaaagtacgtcttgtcgatgttcttggaggaagataactccttcttctcgttcgtcgccgcgctgtccgatgacgaggcgctcggcgccgtgcagtccgctgccgccctcctggacttcctgctctccgtggtggtccgcggcaaggagaagctcgccgccgcggggcaccactacgactccatcgcggacggacgcgcgcgcgccgcgttcgagttccgagacctgcgcgagctggcgcagctcttcgaccggcggccctgcggcgtccaggaccgcgtgcgtgtgcgcgacgggcccgcgcgcgccttcgtggacgcggcactggggctcatgcgcgagcgaggcttcgacggcacgcaggccgcggagcgcgcgcgctacatcgcgccgaacgatctgcccgcgctgggggcaatatcggccacgctctcgccgggtctataacgtaaaaaatattagtaaaattctgaaggtccgtgtgtttcgcgggcggccaacaaaccagtcgcttaaatggagggggtggaaatggacaagccgctcctctacttcgacgagatcgcgggcgcgcgcgactacgacgcggccttcgcggagaagcacgagccgcccaagatccccggccgcggacagatgaagctgctggtctgcgagctcgtgtttctcaaccggctgcacctgcacggcatgctcgacggcagcgtcatcgtgtacgtgggctccgcgcccggacggcacatctgctgcctgcactcgcacttccaggagctcggcgtctcgcttaagtgggtgctcattgacgggcgcaagcacgacccctgtctctcggggctgcggaacgtgaccacggtgacgcgattcgcggacgaggcctacctccgcgagctgcgcggcgagctgcggcgcgccaagatcgtgctcatttcggacatccgctccaaccgcgtggacacagagcccaccaccgcggacctgctgcgcgactacgcgctccagaacaccatggtgagcgtgctcaagcccgtggcctccagcctgaagtggcgctgccccttcccggactcctgggagaaggacttctacgtgccctgcggcaaggagatgctgcagccgttcgcgccgccgttctccgcggagatgcggctgctcaccgtgtactcggagacgcgcccgaagctgcgtctgatcacgctcagcgacgcggtcaactatgaaaagaggatgttctacctcaatagcgtggtccgccagcgcgtaattctgaactttgactatcccaaccaggagtacgacttctttcacatgttctgtctgctctcgtcggtggtgtgctcgtgcgaatttaaatcgcccaaagagaaggtgctgagcctgcagaaccgcttcttccgcttcctgcgcatcccgccctccatcacgctcgggctgcgccggcacgatgaaccgccacaacacgcggtacctggccaagatcctctgcctaaaggccgcggtaagaagcgaccccttcgcggtggtaagtagggacaccgtgcgcatgtacgacatcgaggtcgagtacggcgacctcgtgacggtggtcaccgtcacgcacaaactcgagaccagccgcaccgtcttccaggtcttcaacgagacctctgtcgcgtactcgccgctgccggacgactacggcgagcccatcgtgctcaccacgtacatgcagcgcgagcacaccaagttcccgctctccatgctctacatcgacgtggtcgcctcggacatgttccccacgtttaagcgccccaccgaggaggaggccgcggtggtcgcggccatgcagcgcgtgggcgggcgccgcgagcccgtgctcaagctcccgcgcatgctggacaccgagctcgtgtgcaagatactgcacctgcccgagcacccgctgcgcgtggtgcgcttcctgcgccgaaacatgttcacgggcgtggaggtcgccgaccgctcggtgtccgtggtcctcgactgacgaagggcagcacggtcagcgaggccgccgccaccaagcacagcggcagccacgcgcgcgggtccgccacgggcacgaagacgtgctggttcaggtacttcgcctggaagcgctccgcggtggagtccaccttggacccgcaggcgttggtgaggcgcacgaccgcgtccgcgacgcgcacgtccccgagcgatatcacgcagtcagagacgttgcacccggcgatgtttttcttcagcgcgcgcggcagcagcgcgtccgcgcgcttgcagggcgcgtaccagcagtagtagggcaggcgcgtgtcgcggccggtgtcgaccacggcctggctgggcttgaggcacgcgcagcgctcgtcgtccgggtgcgcgtcgcagaaggcgtaaatctcctcgtcgggcgcgtccggcccgggcgcggtcggcggcgccgcgcgacggcggaagaacatctctgaaaaaatacttcgaccagaaaacgaccaccgatcttatttcaaagataaaaatactattaatacgcactcggagaatcatgtcggtggtggcgcgcgtgtcgtacagcctgtactcgcagagcgagataagcgccacggacgtggtcatcagccagttgaagaacgacgaggacctgggcacggtgaaggacccgcgcctgggcgcctcggacgggtccatatgccgcacctgcgggctcacggagatggagtgtttcgggcactggggcaaggtgcgcatctacgagtcctacatcgtgcgccccgagtacatccccgaggtggtgcggctgctcaaccacctctgcgtgcgctgcgggctgctgcgctcgcgcgacccgtacacgacggacttggccgcgctcagcgtgcacgagatgcgcaagatgaaggaccggatgatgtccaagaagaaggcctgctggaacagcaagtgtctgcagccgtaccagaagatcgtcttctccaagaagaagatctgcttcgtgaacaaggtggacgagatacccgtccccaacgcgctcatctaccagaagctgacctccatccaccgcaagttctggccgctgctggaggtgttccaggaccccgcgaacctgttctacaaggagtacatgcccgtcccgccgctgctcatccggccggcgatcagcttctggatagacaacatccccaaggagaccaacgagctcacctacctgctgggcatgatcgtgaagtactgctccatgaacgccgaggagcaggtcatccagcgcgccgtgatcgagtacgacaacatcaagatcatctcctcgaactcgagcagcatcaacctctcctacatcatcgcgggcaagagcaacatgctgcgcagcttcgtggtcgcgcggcgcaaggaccagaccgcgcgctcggtcatcgggcccgactccgcgctctcggtgtgcgaggtcggcatccccgactacatccggaacacgctcacgcagaaggtgttcgtgaactacctcaccagcaagcgcgtgcgcgcgctgttcgaggaccgcgcggtcaagttctacttcaacaagcggctgcgccagctcacgcgcatcaaggagggcaagttcatcaaggacaagatccacctgctgcccggcgactgggtggagatccccatgtccgagggcacgaacgtgatattcggccgccagccctcgctgcaccgacacaacgtcatatcctcgaccgcgcgcgcctcgcccggctacaccatcaagatcccgcccgggatcgcgaactcgcagaacgcggacttcgacggcgacgaggagtgggccgtgctcgagcagaaccccaagtccgtgatcgagcagagcgtgctcatgtacccggtgactatcttcaagcacgacgcgcacggcgcgccggtgtacgggtccatccaggacgagatcgtggccgcgttctcgctgttccggcaccagaacctctcgctggacgaggtgctgaacctgctcgggcgctacgggcgagacttcgcgccggagcctggccagaagaccttctcgggcgccgacgtcttccgattcatgataggcgcggacataaacttcaagggcgtgctcgagaacgggcgcgtggtggcgccgaacgtcgacagcgacctcgtggtggccatgcgcgcaacctcgctagcggggctgatcgcggactacgccacgaacgtggagggcgtgcgcttcgtggacatggcctcctacgtgtacaagcggtacctggccatctacggcttcggcgtgaccttccgcgacctgcgcccggacccgagtttggttcgccggctgcacgcgctgaacaccgagaagatagagcagatcaaggacgcgtactcgcggtacctgcaggacgtcgcggacgggaagctggtgccgatggcgcccgcggacgaggccgacgcgctggactcgctgctggccaacctgaccaacctcaacgtgcgcgagatcaacgagtacatgcgcgagacgctggagcgcaaccccgataacagcctgctaaagatggcgcgcgccgggtacaaggtcaaccccacagagctcatgtacctgctgggcacctacgggcagcagcgcgtgaacggcgccgtcgccgagaccaagatatacgggcgcgtgctcccgtacgcgttccccgactccgcggacccggaggcgcgcggctacatcatcaactcgctcatgaacggtctctccggctcgcagttctacttcgcgatgctggtggcgcgctcgcagtccacggacatcgtctgcgagacctcgcgcacgggcacgctcgcgcgcaaggtcatcaagaagatggaggacacggtcgtggacgggtacggacagatcgtgagcggctcggtactgctcaagtacgcggccaactacgcgaagatcccggggtccaccaccaagcccgtggagctgctcttcccgcacgagagcatgacctggttcctggagataagcgcgctctggacgaagatccggcacgggttcgtgcgcatgcaccggcagcgcctggccaccaagatcctggcgccgttcaacttcctggtcttcgtgaaaccggcgccctcggaggcggaggcgctctccgcgcgggacctgtaccacatgatccagcgcgtgatgaacgacgtgcgcgagaagtacttcttctcgctggcgaacgtggacttcatggagtacgtcttcctcacgcacctgaacccctcgcgcgtgcgcatcacgcgcgcgaccgccgagctcatcttccgcaagctgtaccagaagctgaacgcgctgctcggcggcggcacgcccgtgggcatcatgtccgcgcaggtgctctgcgagaagttcacgcagcaggcgctctcgagcttccacaccaccgagaagagcggcgccgcgaaggtgaagctgggcttcaacgagttcagcaacctcatcagcatgagccgcaaccacaccgagatagtggcgctgaccgcgccgagcgcggacaagctgatgccgctgaaggtaaacttcgagttcgtgtgtctgggcgagctcgtgcccgagatcgagacccggccctcgggacggccctccgtgcaccgcgtggacatcacggtgcaccgcctgcgcatcaagcgcgcgcacctgaccgaggtcctggtggacaccatcatcgagcgcttcgtgtccttcaacgtgctcgtgaaggagtggggcagcgacatgaccgtggagggcgaccgcgtcacgtacacgctgctgctgcgcttcgtggagccggagcagctcaacttccacaagttcatgctggtgctgcccggcgccgcgaacaagggcaaggtgagcaggttcaagatcccgatcaccgagaccacggtctacgacgacttcgacgccgcgcgcaaggcctaccgcatgaacatcgagctcatgagtctgaaggagctggggatattcgacctcgaggacgtgaacgtggtccccggcatgtggaacaccttcgacatattcggcatcgaggccgcgcgcgggcacctctgcgagagcatgctggacacctacggcacgggcttcgactacctgtttccctcctgcgacctgctcgcgagcctgctctgctccgggtacgagcccgagtccgtaaacaagttcaagttctggaacgcgagcgcgctgaagaaggccaccttcggcgacggccgcgcgctgctgaacgcggcgctgcacaaccgcaccgacgcggtcgcggacaacagcagctgccacttcttcagcaagacgccctgcgtgggcacgggctactacaagtacttcgtgaacgtggagatgttcatgcgcatggagcgcgagatccaggcgcgcgtggcggcgcgcaagatggaggagatcgaggaggccgccgaggaggagttctaggcgcgacggcgccttactttgcgaccgtgtcacgacgacacgacacggttaggacggcgagtcgcagacgaacatttttatgagctggtagcggaagttggcgttttccaggaaggcgccgcggaggtcccggatctcgtagtaggttttgaggaagtacacgaagcgcgcgggctgcgtcatagtcgggttctccgcaagccgcttgtgcatcacgtaccccatggcggcggcgccgctgcggttgacgccggccacgcagtgcacgagcgtgggcttctgctcggcctcgaggcgcgccagcagcttcacgagcgcgggcatgatggaagcgatgttcgtcgtgtcgtcgtctctcagcggaatgtggtacgccgttatccccgcgggcgtcgagtacttggacatggtcatgttaaccagacacttgaagtcgacgccggagtccccccgcagcacggcgcgcgcgtcctcggcgctgcccaagtacacgtggtccgtgagccgcgtcatgcccgagggcagggccagcggcggccccgcgcgcgtgcaccgcagcaggagcctggcgtaccactcgctcttatcgcccatatttatttatatgatacaaatggcagacgtcacaacactgacggccaacggtctgaccctggagttcgcgcgcgagcgcgctctgcgcagtctgcgcgccgcgcgcacctccacgctggtgttcttcacgctcacgctcgcggcctcgctgttcgtgctctggctgcagctaaccgagtttcccgtcttcgaggagctcggcaagtacgcgcgcatcaagagcgcggtgcggtcctggcgcccgctggtggaggctaagacagagatcgagtccgacctcggccggcagaagaccgccgaccggcccgagctcttcgagttcaggtgcgtggacttcggcaagttctacctgccggtgaggtacagccccacgaccttcctgccgcaagccgtgcgccgcggcgcgggcgatggctggatggtgcacaaggcggcggccgtggacctcgccgcgcagcagttctgcgagtccgtgctgcggcaccgcgccaacaacgtcatcacatgcgggtcagagatgatgcggctggtgggctacagcggctacttcgaggacgaccactggtgcgccgcgacgtccggcgtgctgacgtgaacgatcacacgatggccgtgaccagcagcccggcgatgaaccacagcagccgcgagttcggcagcagcagcacgagcaccagcaggtacgccaggatgaagatgtcgaccacgtccacgtcgaagagccccatgaaggagaagagcggcgtggtgaggaagtagatggcgccgggccagaagcgcgccagccacgtggcgagcagcgaccacagggagggcgcgccgctgagccgcgtcttcacctgtatgtagtactcggggtagaccacctgctcggcgccggagagcaccacgcgcgccagagagagccgcttctccagcgtgaacacctcggtgagcaggccgctgcgcagccctccctccttgatgatcgcgtcgtagagcttcttcatgccgccgacgctgatgatgtaggcgtctagcgagacgtcgtacccgccggggtagaccatgagctcggggtcgccggtgccggggacgttggtggccagcgcgccggtcatgtaggtctccttgagctgcgtcatgtaccagccgttcgccttcatcgcctcgatgagcggcttcaccatctcgggcttgcggaaggtcatgtcgttgtcgaccaccaggatgaagtcatcgtcggagtacttggtggggacagtgccggccgatatgctctcccagaggttgaggtggtgcgctgcgcggcgctgcatctccttcggacacgtggacttgcacatgtccgtgaagaagtgcgggtagtctttggagtccacgtctttccattccaccgccttgagcacgtggtcgcccttggggtgcggcgcgggaggagatggcttgggtgccggcgcgggggccggtgcgggggctggggcaggagagggagcaggcgcgggttgaggcttgggcgggtcgtcggcgaggcccaccaggtacggcagcgtggggaacacctccttggtcccgcggccttcggcaaccccgattatgtaggccgtgatttcgggtggatccatttagttattaaaattaatcatatacaactcttttatggcggctatggattcggctatccagtccttgaccgagcccacgatgcccgccaggaacaggaagaaggcgaactccaggtccacgcggttcagagagtcgctgaagtacacgaagacgtcgctgtccgggaagaagctgcgccggaacatgttgtacccgttgaccttgtgcgcgacgtgctccgcgctcagcagcgtctcgtcgaaggggtacgggtcgctgaagcggaacacgtacatggccgggtttgcgtagtagtacttcatggtgtttgtgacgaagaggctcgccagcgagatgatgatttttttcttctcgatctcgatcttgatgtggtcctcgaagcgcttcatgttgtaggcgttggtgtcgtgcacgcggatgagcacgcgcgagtccgacatgatgtcctggaactccgcgcgcgcgtcggggctctcggcgggcgtctccgcgggccgcgccacctccgcgcacaccgtcggcctagcgcgcggcggcgtgcgcatgggccgcgcccccacgcgctgcgaagcgaaaaactccacggcgcgagcctcgcccgcgtccgcgtacgactccaccaggtagttgcggctgcgcgtggtgcggccgatggtgttcagccggtgcagctccgcgaccagccggcggtagtgcgcctccagctcctcgggcatgatggaggtgtacacctcggtgagcagcatcacggtgtcgaagtcctccttgccgcagacgcgcgtcttcacgaggaagtggtgcacagccgtcgcgatagagagccgcagcgtggactcggtgacctcgacgctggcgtccttggtcttcttcgcgctccgcgaggccatgaacgagacgaggaagtccgcgctgctgttgagcacgatgaccagcgcgacgatgaagttgaggttcagcgtcttcgcggactggaacagctcggtggccgacgcgtgcacgtcgagcaggttcgcggagagccgcaggaagaacacgccgcgcttgatctcggccgcgaagcgacgttcgtactcctgccggcgcgcgttgatcgcgatgaggaagttcaggatgagccggttgatgttgtacttcacggcccaggtctgcgtcttcatgatggtgtcgaaggacatcacgatgttgaagatgaagcgctggctgtgcgagaagtagctgtagggctcgctgaggaagatggacttgttggtcgcgggcaccaccacgcccgcgcgcgcgccggacgcgtcggtgttcaggtccgggatgttcatgccgcagatgcggcagtaggccatgccgtcctcaaagtacacgaactcctccacgaactcgttgatcttggcgaagtagtccacgtccacgcgcatcgcgaccgcgagccggatctggtgctcgcagggcggcgactcgaagcgcaccccctcgccccagcccggcggctcgcgcacgaccagcgcggtgcgcgaggccgggcggaacttggcgtcgcgcgcgttgagcagcgccgggaagaggtcgcagaggtgccggctcgagaggaacacgtacttgtacagcagccggcgcgcgtccgcggccatggcgtccacgaaggcgcggccccactccgcgaccgcgggctgctcctccgcaaagttgttcgggtagaccttgtccgtggccgcgaggaacaccttcttcacgtcgaggaagtcgcggatcacgatggggacgcgcgcgccgtcgagctcgtacatgaacacgtagcgcaggttgagcttgcgccgcgagaccgggatgccgatgtgccgacacaggtacgcgaactcgaggtacttcttcgagaagcggatgcggtccaggttcttggagacgtactgcagcatgttgcgcatgttgaaggggatctcgcgcacggcgggctccgcggcgtcgtcgaaggcggtgcgcagatcgctggtgcgctgtacgaccacggcttcgccggtggcgtcgtcgtgcaccagcacgttaacgcgccgctgccggatgaccatgtcgaaggtgttgaagaacatctcgtacatgctgtgccgagtgtcgtccgcgatgcgctcgcccaccgagaggctcgcggtggcgtcgtcacgcacctgcttctcgaacttgtacccgatgtaggagaatatcgagatcagcgtggcgtcgtcggcgtcggggttctgctccatggtcgcgaagagcaggcggatgtcgtcctccgtgatcgcgtccacgttgtacaggttgaccacgaagatggacttgttctcggcgatgaagtccgtgtaggacttggtggccgtgttcgggtcgcgcatgtacgcgcggatcttcggcacgatgctcgcgaggatggactccctggaatccatttaaggacggcaagggcgcgcgagaccgtctcaaaactgaaatcgtataaactcttaaaaaatcggtattgaaagtacgcaccaccaaataaagcgtcgaggtcgggcatgtcttcgtggcgactcaaaatgagcaagtgttcaggttccagcagcgtccagactctcgaggatctgcgtaatcgtcttcgctccgaggccttgggcaacgattgccaagagccccgcgacgacctcttccccagcggcgaggagtgtctggacatcgacgggccctgcccttgcgatgaggcggagcaggagatcgaccaggagcagttgcccgtgcccgaaaccgtgcccgaaccgccggccaagactcctaagcgccgaccagtgaagaaggataaggcagataaggcagataaggacaagtcgaccagaggcgcaaagaaaccgtgcccttcggacgacaaggatgacgagctcaagagcaacgacgtcgacaacaacgaagagtccggcgacacagacggcggcgcgagcgcccgaagccccagcgacatcgacaacgtggacgaaatggacgactccgacctcatggtggcgttctccaccatcctcgcagacttcaaggaccttacccaacgagtgaaagctctttcgtccgtgctcacggacgtgcaggcggccggcatacgcaggagcttctcgacgctcggcaaggctctgacggaggcggcccacatcgccaacaccggatctaagccagtcactgcgcctcgcaagaagaaggccgccgcctgcaagaagtaggcgcactaaatagcgaggctcggtatgcgggcgctgcacctgtcagacggcaaacttttttttgacaaggagctgacgcagccggtccccgacgacaaccccgcgtacgctgtccttgcgaagatccggatcccaccgcacctctcggatgtggtcgtgtacgagcaggacctcgagtctgcgcagcagggcctcatcttcgtcgggcgcgacgccaagggccgaaagcagtacttctacgggcgcggacacgtggagcggcgcacggccgtccgcaacgccgtgttcgtgcgcgtgcaccgcgtcatgaacaagataaacgccttcatcgacgaccacctcgcctccggcagcgaggccgaggcgcagatggccgccttcctgctcatggagacgagcttcttcatccgcgtcggcaagacgcgctacgagcgcgagagcggcaccgtgggcatgctcacgctgcgcaacaagcacctcgccgaggccgagggcggtgaggagatccgcgtcgccttcgtgggcaaggaccgagtcgcgcacgagtttgccgtgcgcgaggggcagcggctcttcgcggcgctgcgtcggctctgggacccgggcgcgcccgacaggctgctgttcgaccggctgagcgagcgccgcgtgtacaccttcatgcgacgcttcggcatccgcgtcaaggacctgcgcacctacggcgtgaactacaccttcctgtacaacttctggtccaacgtgcgctcgctggagccgcgtccctccgtgaagtcgctcatctgcacctccgtgcggcagaccgccgagacggtggggcacacgccctcgatctcgcgcagcgcctacatggccaccgcggtgctcgagctcgtcagggacggcgcgttcctggacagagtcgccgccaccgacacgctcgacgacttcgtggacatcgtcgtggactatgtaaataactctgagcaggtaaatggatgaggcgctgcgcgtggcggcgcgcgtcgtggacgggctccggccgctggacgtggccgtgtgtctcgcgcagctgcgcggagccgcgcccgagcgccgcttcccggcgctcgacgagtgctccggcgaggccttcctggactttgagttcgccggcggggacgtggcgtcgcggtacctctccgcgcacacgcgcgagctccgtgcggcggagcggcgcgagcacatggccgcgatcgcgcgctgcgtcaccgaggccgacctggcgctcgcagaccgcccccggggcaaggcgcgcgcggcgctgcgcgtgtgccgcaaccgcgagaaagtcgcgcgcttggcgaggctgctgcgcgacgccgagagcagcggcgcggacttcgccttcatacgcgcggccgtggcgtagcaaaacgtaaaaacaacacattccctaaatcgccatggacgcgccaagtctcgactgcatgctcgccgcactcgcggcgaaggcggcctcggtggaccgaggcgctcccgaggacgaggtgcaccacgaagtggagctcgtgctcgtggacccgccgctgtccaccctggccgccacgctgcgcctggcctcggagacggagtccttcatcctcttcacggtgaccgcgctcgccaaggaggagggcaagctgcgcgcgcgcgtgcccatgtcgcgcgtcgtcggcctggacgtgaagaacgtgcagctggtcaacgccatcgacagcatcgtctgggagcgcaaggcgctcgtggaggagaccgcgctgcaggaaggctgtctgctgcgccactccaccgagcggcggcacctcttcgtggactacaagaagtacctctcggccatccgcgtggagctggtaaaccgcgtgcgcgtgcgctccaaagaagtcgtcgcggacttcaagttcaagtactttctggggtccggcgcgcaggccaagagctcgctgctgcacgcactcaaccaccccaaggtgcggccctcgcccacgctggagttcgaggtcgtccccgcgggcgaggccgtggacgaggccgccgtgctcgcggagctgcgcgccgtggcgaaggcgctcttcatggcgcccaccgacgccgtcttcctggcgccgccggccgagatgccggtgcgcacgctcatgctgcagaagcaggagatccccgcgctagacctcgacggccttttcgcggtctccaagacggacggcgtctccgcgagcgtgtgcgtggacgaggacggcgtcttctgcgcgttctcgcacctcgcgtacaccatccggtacccgctcgcgcgcgaagtgcagggccggtaccggctctggtgcgaggccgtgcggcccgtgggcgagcgcgtgtggtccatgttcgtgctggtcgtggaggagcctgcgggcgatgaccgcgtcgcggccgtggccggcgccgtggaggcgctgcgcggcgtgtgtgcacgcgtcgagttcaaacctaagcgcgtggacgggcccttctcggcgacctccgagctggtggagcacatcaagagcgcgctgcagacggagccagagggcgtggtgctcttctacgcgcgcggagagaagtccaagcgcgacctcaaggtcaagcgcgacaacacggtggaccagaccacgaacgtgatgttccggtacatgtccagcgagcccatcgtcttcggcgagggctccaccttcctggagttcaagcggtacagcaacgaccgcgggttccccaaggagtacggcgcggggcgcatcttcctgcgcgaggacgtggtctaccacaacaacatctactgcatcgagttcacgaagacgcacctggaggtgggcctccgcagcgtggtcgtgcccgtgaagttcatcggcgagttctcgcaggaggggtacctgctgcggccgcgcctggccaaaacggagtgctacttccgcaacccctcattctacgggaaccagcactcggtggtgctcgagcacactcgcgaccagctgctctcggtgggggacgtgttcgacgagagccgcatggccgccgtcgggcagacgctggccaacgacgccttccgcctgaacccggacacgccctacttcaccaaccgacgcacgcgcgggccgctgggcgtgctctccaactacgtgaagacgctcatgatatcgctgtactgctcgaagaccttcctgaacaacgccgagcgacgcaaggtgctggccgtggacttcggcaacggcgcggacctggagaagtacttcttcggcgagatcgcgtccatggtggccacggacccggacgcgcgcgcgatcgagcgcgccatggagcgctacaaccgcctcaacgcggggctgaagtcgcgctactacaagtttaactacatccaggagaccatccgatccgagacctacgtggagagcatccgccaggtcatgtacttcgggcgcttcaacatcgtggactggcagatggccatccactactccttccacccgcggcacttcgccacggtgatgcgcaacctgcgcgagctcaccgcgcccggctgcaaggtgctcatcaccaccatggacggggacttcctgtcgacgctctccgagaagaccagcttcgtgatcaaccgcaacctgcaggagagcgaaaacttcatgtcgatcgagcgcgtggccgatgaccaggtcatggtctacgcgccctcgaccatggcgcagcccatgacggagtacatcgtgcgccgcgcggacatcgtcaagctcttcgcggacaacggcttcgacctcgtggaccacgcgaacttcgagaccgtgatccggcgcagccgccgcttcgtcgagggcgtctcgcggctggagacgcggccctccaccaagaacttcttcgagctcaaccgcaacgcgctcacggagatggacagcaccgacgtggccgcgctgctaaagatctacgtgctgtacgtcttcagcaagcggtaggcagaaccagggcgtcgattccgcgcccgcgccggcgcggaaggcgttgaacagctccgccagccaggctgcggtctcgcgcgcgtcgatcgggccgccgtcgtccggcggcggctcgcgcgccgcgcgcaacaccagcgtctccgcgggcggcagaggctccagagcctcgaagaccgcgcggctcgggaacagcgcgcgcatcatgcgcgcgcggtggccgaacaccgccttgaccgcgcgcagtgccgagcggttgtccagccgcagcgctcggtcaaaacgatgcacgcgcgcgggcgcgccgcggtggtcgcgctccacgagcacgtgccgccacgccagcgccgcgccgacgcggtccaggctgggcgcgagcgccaccaggcttttcagcgcatgtaaatctccgcgcatggccgacggctccatttactactgcggaggaacgcacgtggtcgcggccgcgccgggcgccgcgcttgtggtgctggacgcgcccggtgcggcggcggcggccgcgcccgcggggcagcgcgtcttcttcgccgagtacggcctcgagaagcgggccggcggcccgatcacggcgcggctgcgccgctccgggttccgcggcgccgcgaacgcctgggcctccgtggcggacttcgaggccggcggccgtccctccgcgtggacgctgcgcgcggaggaggcttcgcgcgtgccgctgccgacggacgcggcgctggtcctggcctggggcgcgcgcgaggagccgctgcgggcgtgcgtgctggcgcgcgcggcagacgcggaggcgccggtgggcgccgcgctcaaagaagccgccttcgacgcgcgggcgccggcggccgcgctgttcgcggcgctgggcgcgcccgcgctcgcgcccccgctgcgggcgcggctagtggcgccgccgggcgcgccgccgcggacgcggctctgcgagaacccggccatgctgcgcgcgttcgcggtgggctggttcggcgcgcagctgggcgaggcctccgaaaatgaaaaggtatttgccgcctttgataaggcgaggtcgtgtttggacgaccgctgatggcgacgcccgcgaacgcgcccgcgctgctcgtcgcggcgctgcgacaccgcccgtaccgcgtggagtaccacccggactgggagccggtcatcgagacgctggtggacgagtacgacgcggtcgcgccctggctgctgcgcgacgcgacgagccccgagcccgagcgcttcttcgcgcagctggcgaagccgctggcggacaagcgagtgtgcgtgtgcggcatcgacccgtacccgcgcggcggcaccggcgtgcccttccagtccccggacttcagcaagaagaccatccgcgcgatcgcgagctcggtcgcgcgcacgaccggcacgcagggctacgcgaactacgacctggacgcggttccgggcgtgctgccctggaactactacctctcctgccgcgagggcgagaccaagagccacgcgatgtactgggagcgcatctcgcggctgctgctgcagcacgtggccaagcacgtgagcgtgctctactgcatggggcgcacggacttccagaacgtgcgcgcgcgcctggacgtgccggtgacgctggtggtgggcttccaccccgcggcgcgcgacgggcagttcgcgcgcgagcgggccttcgaggtcatcaacgccttattggagctcaacgggaagtctcaagtggactgggcgcgaggattttctttttatagtgaaaattaatccgtggtcctaaatggcggcgcccatatgcgataactctcacgtgttcctcctcaagcgcctgggcgtgccgtcttcctgccggcgctcggaggacccgcgcttcgtggagatcctgactcccttcgagctctcaaactacatcgagcggcacccgggatgctgcctcttcgagacgctgcgcgacgaggaggactgctccgtcgtgcgcgtcttcgcggacgtggacatggacagcgtgctcgaggaggaggacttcgtcgcggcgctggaggacctcatcgtggagctcgcggccttcttcgaccgcttcgcgagcggctcctgcggcaccgtgcccggcgaggtcaagcgcgccatgctcgcgaacttctcggtcacgcgatccacggccgagcacaagaccagcttccacctgatcttcacggagacgtacaccacgctggacacgctggtggcggcgaagcgcccgctgctggacctgtgccggcgctcggacaacgtgctgctgcgcgcgctggacacggccgtgtaccgccgcggcgcgacgctgcgcgtggtgggcacgcgcaagacgccggagtcgagcgcggtccaccgcatgcagtcgcccgacgacgacatcaaggactacctgttcacgttcgtggagctctcggacgcgagcgtgtacttcgagctcgcggagcgcgagcagcacacgctgagcaccgtctgctgggagacctcctacatccccttcggcgacgcgatgcggcgcgtgtgccaggcggtggtcaacgacatcgtgaacctccgcgacatcaccgaggacaacttcctcgacacgccgctggtcatcgactacgcgacgcgctgcgcgctgtgcaagaagcccaagcacaagcacgcgcaccacatcaccatgggcaacggctgcctgcgcctggtcaagggcgggaacgcgcacagctgcaaggtcaagatcatccagctcgagggcaaccggctcttcacggccgcgcagatcatcatcgcgtccgaggtcgtgaagctcaccgagcgcaacgactacatcgtgtggctgaacaactcctggcgcttcagcgcggaggagtcgctcatcaccaagctcatcctggacgtgcggcactcgctgcccgcggactacgccaacgacatgctgtgtccgcgcaagcgcaaggtcgtggagaccaacatccgcgacatgctcgtggacatctccgagacggacacgcagtacgacaagctgcccttcacgaacggcgtgctggacctggccacgggcgagttcctcaccggcgaccgcgcgaaggcctgcgtgtgcacggtctccaccgggtacgccttctcgcgcgaggagttcgcggccgcggcggactcggaggccatgcgccggctggtcggcgtcatcgacgacatccagccggacacgcccgagaacgccgataaccgcgcgctgtacgagcgcgccatgtccagcgcgctctgcggcgccacgaagacggtcatcgtcttcttctacggcgacaccatgaccggcaagtccacgagcaagcgtctgctcatgtccgcgctcggcggactcttcatcgagaccgggcagaccgtgctcacggacgtgctcgacaagggcccgaaccccttcgtggccaacatgcacctgcggcgcgcggtcttctgcagcgagctcccggacttcgcctgcaacaacgcgcgcaagctgcgctccgacaacttcaagaagctgaccgagccctgcatcgtgggccggccctgcttctccaacaagatccacaaccgcaaccacgccaccttcatcatcgacaccaactaccgcccggtcttcgaccgcgtggacaacgcgctcatgcgccgcgtggcgctggtgcgcttccgcacgcacttctcctcgtcggccactcgcgcggccgccgcgcacaacgtcgagtacagcgcggtcaaggagatggacgagagcctggacaccaagatccagcgcaactacttccgctacgccttcctgcgcctgctcgtgcagtggttcggcaagtaccacgtcccgcaggtctcgctggcgcccacgcccgacgcggtccccgacttcgccttccaccgccgcgtggccgagctggtggtggccagcaacgacgcgcaccgccgcgcgatggagtcgctgtccaagctggggtacgtgctcgtgggcggcaacgtggccatgcccgcggacgccttccggcagcggctggccgcgcacttcaacgcgcgcgtgcacggcggcgacatagacgccttcatgttcaagcacaagaaggtcgtcaacgtaacggaggagtacgtggagtacgtattcatcgaagatgtcgagaataaatagacgggtatgaactcggacgtgataaagctgttcgtcgggcacgacgagtccgtgcccggcatcctgccgcaccagctcgcgaccgtggacttcctgatacgccgcgttctagacgacaacgtcagcgtgcttctcttccacatcatgggctctgggaagaccgtcatcgcgctgctgttcgcgatggtggcctcgcgcaccaagaaggtgtacatcctggtgcccaacgtgaacgtcatgaacatattcaactacagcatggtcatggtcgctaacctgttcaacgcgcccttcgtggccgagaacatattcgtgtactcgacgactagtttttattcgctaaactgcaacgacggcgtcataaactacaacggcctcggcaagtacgagaactcggtcttcgtggtcgacgaggcgcacaacatcttcgggaacaacaccggcgagctcatgatggtgatcaagaacaagacgcgcgtgcccttcctgctgctctcggcctcgccgatcacgaacacgccgctcacgctcagcagcatcatcagcctcatgtccgagaaggacgtggacgtcggcgacatcgtggtgcagggcaagaaggtgttccagatcctgctgaacgagcacggcgtgcgcgtgatccgcgaggtgctcaaggggcgcatctcctactacgagatgccggacacggacatgcccgaggtgctctaccacgggcgccgcttcctggacacgcgcgtggtctactgccgcatgtcgcgccggcaggaggacgactacctcaccgtgcgccggctctgcaacaacgagatgttcgagaagaacatgaacaacgtgtccatggcggtgctgggcccgctgaacctggtgaacaacctggacgtgctcttccaggcgcaggacaaggacctgtacccgaacctgcgcatcagcaacggcgtgctctacgggaacgagctcaccaagctggacatcagctgcaagttcaagttcttcatctcgaaggtgggcgccatgcgcgggaagcacttcatctacttctccaactcgacctacggcagcctggtcatccgcaacgtgatgctcagcaacgggtactcggagttcggcggctcgcagagcaacaatccgcacaccacgcccgacgggcgcgccaagaccttcgcgatcgtgaccagcaagatgaaggcctcgctggaggagctgctcgaggtgtacaactccgcggagaacaacgacggtggcaagctcatgttcctcttctcctcgaacatcatgtccgagtcctacacgctcaaggaggtgcggcacatctggttcatgaccatccccgacaccttctcgcagttcaaccagatcctgggccgcgccgtgcgcaagttctcctacgcggacgtggccgcgcccgtgaacgtgtacctcatggcggcggtgtactcggacttcgacgaggacatcgtctcgctggaggactacagcgtggaggacatcaacgcgctgcccttcgacgtgaagaagctcttctacctcaagttcaaggccaaggaaaccaaccgcgtgtacgccatcctgcaggagctctcggacgcgtactccgcgcgcccgcacccgcagctcgtggacgtggtgctgggggagatcgtgcgccagttcttcgcacggcactgccgcgtgcccgccgaggacgccgcgctcgtggccgccgtcgaggccgttctcggcacgcgcgaggcagcggccgagtacatccgcgcgatagtggacggacacttcttcgtgaccaacaagaccttcgggaagtgcctgctcttccggcacgagcgcgacatcgtgaccgtgcccttcgagctcgagcacgaccccttcgcgtgggcgatcaacttccgcaaggaggtcagtgtggtgaatatataacggcaaacataaatagaaagactgtccttttgcgcgatgtcgaccttccggcagacggtgtacctggcggtgacgctgcagccgcacgagctcacgctcgacttccgcggcaacgtcgcggaggcggtcatgcgcgagtacctctacaaggagaagggcgggctcatggccaccgacatcgaggtctgcctcggaaacgagatgccgctggggcgcatcgtgaacaacgcggttgtggtctcggtgccctgcaacgtgaccttcaagtactaccgcgtcggcgacaccgtgagcggcacgctcaacgtcgaggacgagaccaacgtcttcgtggactgcggagacctcatctgccagctcggcaagagctcgggcggcgtgaccttcaacgagtccaagtactgcctcgtgcgcaacggagtcgtctacgagcacggcagccgggtctcggctgtgctgcgcgaggcgcgctccggacgcgagtccgcgttcgtgttctccgcagtgctgctggacggcgtccccgccgaggagaaggacgagaagaaggacgagggcgagaaggccgcggaggaggagacgcccgcgagccccgccgccaaaaactagcattattgggccgcgcgaaccttcgataaatgcgcacgtacacgtcgctgctctcgaagctgctcaagagcaaccggcggctcgggagcacgcgcgtcttccgcgacccgctgcagcacatcagcgcgaccgcctttgtgcaccggcgcatcgaccggcaccggcgcgtctccatctgcgccgtgctcaccaccaccgacgggctcgtggtcgcgtgccggcgccggtactcctttttgtcctccgagctcgcggagacgcgctcgcccgcgcggcgcgtgctgctcgcaaccaagcacgcggacgctctcgcgcgcctcggcgccgcgcgcccgcgcgacgacgtcatgtttccgggcggcgccccgctgtccggggagtcgccgctggcgtgcgtgctgcgcgaggtcgaggaggagaccgggctgcgcggcgaccaggtcagcgtggacgagcggctgttcgtgcacgccttcatcgacgacctggtctcgggccgcgacttcgacgcgatcatcttcacgggcgcagtcgcgctttcgagcgcggaggtggcgaagcagttccggcccaacgacgaggtcaaggggctggtcttcctgcaccccgaggacgcggagggcgtgggcgtgatggcgcggctggcggcgttcgcgcgctgcgcggcgcgcctgcgctgctggggcgcggccgtcacgcgatagaggcggggtccaccacgtacacgaggcgcccgccgctcacgcgcacggtgggcgggtcgcccagcgcggtcaggaagttcccgtcgtcgtcgaagaggcgcccgccgcgctcgaggaagcccttgcgcaccgtgaccagcgccgtggaggtggagtaccacacgctctgcccgtccgcgagccgcgccgcgcgcgcgggcccgcgcgcgtccgccgggcgcgccaccagcgcggaccagccggagtcgtcctccagcggcgcgaagtccgtgaaggcctcgcgcacccactccagcgagcagcgcttgagcacgcggaagagctgcgtgaactgccgggacttgtcgcggatgagggccagcaggtcctcgtccacggtggcggcgccggagtcctggcgcgcgaccacgaagtgcacgttcacgtagcggcggtcgggcggcgtcatctcgtggctgttcaggcgcaccgcgcggcccacgatctggcgcagcgaggcctcgttccaggtcatgtccaggatgaagatgtcgttgatggagaggaagctgaggccctcggagccgctcagcgagaacacacagaccttgatcttctcgccgtcggtgttgtcgcaggcgttgaaggcgtccacgagcttggcgcgcgtgtcgcgcgtgcgcgaggagaactccacgctggagacgccgaaggcgcggaagtagagcagcagcatctcgatgccggtcacgttgacgaagggctcgaagaccagacacttgcccggcgaggccaggatgcgcaggcagacctcggtgtacttgcagctgcgctcgcgcagctccgcgagcagcgagacgtccgcggaggtcatgcggtcgccgctgacgggcgcgccgctgcggaagagccgcatggccgcctccgagaagacgcggtccttgacggcgcgcgcgaagtccaggaagagcgcggccacggcctcgtcgtactcctgcttggagagcacggacttgtcgggcgcgtcctcgaaggcgaaggtggccgcgatgcgccggtacacgcggaagaccgcggcgccggacttgcgctccatggcggccgcgcggcggtaggcctcggtctgcttcgcggtcatgtccacgtacatcatgcgcacgcgcttgcgcgcgaaggcggcggagccgtcgacgtcgtcgaagatggaggcctcgttggtgactaagtacgagcacaggccgccgagcttgtccacgaggtcctcggggttcgcgagcgcgccgccgttgaagagcggcgtctgcccgaccacgccggggcgcagcaggttcacggccatggagaactccttgacgctgttcaccaccggcgtggccgtgaggcagagcagcttcccgcggcccatggggatgttcttcgcgaggtagttgtacaccgtgcgcgcgggccgctggcgcccgtcctccttggtcagcgacatcgagatgaagttgtggaactcgtcgatgaccacgcagacgcggctgctcgacgaggcggtcttcatcagcgtgaagaagcggtggtggaagcgcgggtcgtcgtagttgatgaaggtgcacccgggcacggcctcgggcgcgaagcgcatcatcgtcgaggtccagggctgctccacgagcgccttcttcacgagcacgaccaccgtccagtccgtgaagacgtcgcgcaggtgcttgagcacgtacaccgcggtcacggtcttgcccacgcccgtctcgtggaagagcagcagcgagtgcatgctgtccaggcccaggaacacgcgcgccacgaagagctggtagtccttgaggcgcacggactcctccacgccctgcatctcggagggcatgtgcgcggtgcgccgcagcgcgtagtcgatgtaggccgcgtgcgcgctggtcatggcgacggtcggcgctccttttacggggtctgtcgtctatctattgtcggcgcgggtctgatttaggggcagtagttacaaaaacgtttccgctgctcggcgcggcgtttggaggagcggttgcggccgcggcggcgcaggcgcgcgcggcgcgtcttcgtggtgcggtggccgaaccagcgccggtgcatgaccgggtgcgagaccgcggccgcgcgatccgcgctcatgcaggttgcgtaggtgcggcacatgctgcgcagcacgcgccgcgtgcgccgctccacggcgtcgagccgcctcgcgacgatgggaaagagccggcgccagccgcgcacggcgaagagcgggcgctcgcagaccgggcgcgcgagcgcgtggtaggcgcccagcagccgcgggtccagcgagcgcacgtaggtctccacgaagccgttgccgaagacgatggcctgtgcgcatagcgggttcgtcatctccctcttggaggcgatggcgtcgcccacgaaggcgcgcacgccgcagtgccgcagcaccaggcgccgccgcgggaagtgcaggtgcgggccgagcgccgcgcgggcggcggggatgtgcagccgcggagaaaaacgcgcgcgtccctccatggcatctaagcgctccgtctgttttcagttatatcgccgcgggcggctactgcagcagcagcttgagcttgcgctggctctcgttctcgatgctcttggactcggaggtcatgctctcgtagagcagcgagtgcgtgacgtagagcgcctcgtacacgcggctggcgaaggccacgaagcggtccacgaactcgctctctacggggtccttgagcacgcggaagggcacggccagcgcgtcgcgccaggcggcggccttggtgcgctcgcgcacgtgcgtcacgaaggcggcgatggccgcgcgccgcggctcgctggcgaccatgacggcgctgtccttgagccagctgtcgctcacgcacttgaagaggcgcacggtgccgaagaggctgcagtacacgcgcagcgcgtgcaccacgtcggtgccgaagagcgtgggcagcttgagcaccacgaagcgctcctgcgtgatctcgagcagcgggcgcatcaccgcgaaggtgatcgcgtggtagtcagccacgtagaggttgttctcggtgaggtggttgttggagcggatggcgccgcgctccttgcggtagagccggttgcgcgcgctgaggtcgagcacgaccgcgtcggccctgccgcgcgctctggagcgcacgctggtgatgccgtgcgcctcgagcaccttctcgacgtcgcgctcgtcgatcatgaggtcgtgcgtgtacagactcagcatctccgtgggcatgcggttgatgtcgttcacgcgcgagcactgcaggaagtagttggtcccgtaggccaggctgggcaggtgcccgacgccgagctgcaggtccagcgcgggcgtcgagtcgaaggtgggcagcgtcacgctgagcccctcgcggatgctgcggcgcacggcctccaccgcgtccatggccgatttattggacgcacagtctgttttcatttcgcggctactgcgcagtcaccttctcggccacgatccccgcgtcgtagctgagccggtacacctcgttgcacaccacgaccatctgccgcggcacgtacatgagcgggttgtgcgcctccatgtgcgcggtggtcacgcgcaccgccagcttgtccttgcccctggagacgttggagttcagcgcggtgggcgagaagaaggtgctgggcgtaaagttgaactgcagcgtgcgcacgccgggcgtcttgccgaggatctcgccgaagacgcgcgagactgcgctgttctccgagtacagcacctcgttgccgaagcgcacgtccatgcgcgcgatgacgtcgatcttgttcttgaagtccacgcccttgaggaaggggtcggccacgaagaggtccttggcgcgcgcctccggcgagcggttgtcgccgttgtacacgttgcgctggcaggtccacacgcccacgggcacggaggcgtcgccgatgttcacggagtggatggcggtcgtgaagcggatgcgggaggtcgcgcggctgtaggcccccgtgatggcggagaacttcttggacatgttgtacacgacggagttcttcctggtggcgaacactaggatgttcgtgtgcaggaacacgcgcatgcccacgggcacgtcgtcgatgcgcacgaagacgtcggtgtcctggatggacacgacgcccgacgggggcacctcgactatctccgcggtctcggggaagccctcggggtagcagttcgagacgatcaccatgtcctccagcaggcgctccacgaaggccatcacgaagtcgccctcggactgctggaagccggggtacgatatgaagcggttgttggcgtcgctgagcacgggcttcatgtacacggacagggaggtgcacgcgtgcacgtccgtgatcaccgcggtggtgtggttgatctgctccacgcgccgccgcggcatctcgatgaaggccgggcgcgggcacaggttcttgaccatgtagccgatgaagctcagctccatggagtaggggaactccttggcgagcttggcggcgtcgaaggtctcgtcgtagaccatgacgcaggcgacggggttcagcgtgaccgtgaccgtgaccttgctgtcgctgagcttgagcgtgctgaaggtcttgtccgcgtcaaagggcgtcttgatgtaggcgtgcacgcaggcggcctccttgatgacgtcgttgggcgagctcccggtggagaggtcgttgagctcgcgcgagaagcccgagagctccatcacgcgctcgttgtccaggcaggagtcgaacagctcctcgccggaggtctcccagatggtgtccgcggcggagttcacggccacgtggcggatgagcttgtacgcgatgtagggcacgtagcacatcttgcccacgccctttatctcgggcaggtccacgctcagcacgaagttgttcatggccgagatgtacttgtcgcggatctcgaaggtcacggtgaccgcgtcgctggtggtgtccaccacgccctgcgtggtgatgtactgcggcatgtacaccgtgggcgcgcggtggtccgtggcgaacacgctggcgcgccgcacggcgtcgtcgccgcccaccaggctcaccacggagttattcatttattccctgggaaaaccagttaaataaggctcttcagagccatgcgcaccgtccggccgtcgggctccaggtagcagcgcccgtagacgccctccgtggcgcgcgtctcgttgatgagcgcgcgcacgcggtcggggtccgcgtacatctccagcggcagcagctcgatcttgggctcctcgcgcagcgcgacgaggtgccggatggagcccgcgaaggagtcgcggcacaaccgcgagcagaactcgcccacggcgccgccgtcgagcgtctccacggccagcgcggccgtgcccacgcgctgacggcagaaccagcacgtgccgtccgcggcgcgcagcgccagccgctccgcggacaccgtgttgaagtacttcggcagcacgtactcgatgcggcacgccgccggcggcgcgcaggccgacgcccgcggcgcggatatgtccacccgcgagagcgcgatgcgcttcatgggcggcggtggctgctatttatgtcgcccgcggcttttcaaaggtcgagcgagcacgccgcgaagcgcgcgggcgagaacacgtactcgtggccgaactccgggatctgcgcggcgcgcttgcgcgcgcgcatgtgcgcgaggaagttctcccaggtgagctggttgctgttgttcttcgcgtagttcttcacggtctgcggacgcaggttgcgcgtcacgcccgtgacctcgaagatcttgtccaggaagaaggagtagttgatggttttggtgggcgtgatctcctggcagaagaagaccagctgcttgaatatctcgatgacctcgttgatcttctcggtgctgaggtccagcttctcgtttttgacctggttgatgatctcgaagaccagcttgtagtccttcttgttgatcatttcgctgtccttgaggaagctggagacgtagttggcgtccacgtcctcgggccggatctggtgccggtccatcatcgcgcgcaggtcgcggatgacctcctccgagcactgcttggagagcagccgccggagcacgttccgcaggtggatgagcttgttcgacacgtggaagttggacctcttctgcacgcggatgcccatgggaaacacggtctcgcagaacaggcagaactcgtagtccgcgtcggacacgagcccgttgcggcggcagccgccgcacatgcgcaggttcatgcttgctccagccccagcacgcgcaggatctcgcggtccagcactttagtgtccagcgtgcgggttctacagaactggaggaagcccgcgagcgcgcgcgcgcgccctggctgcgagagcagcagcatgcgcgcgttctcggggtcctcgttgatgacgcgcgtgaggttcagcgagcaccgcgtgcagcgccgcggcgggtcgagctcgaccgagtacgccgcgaaccagacgttgtcgcccatgtattatttattaacacagaacgtcgcacatgttgcgcgaggacatgtacgggtcgtactcctgcccgtagatgaggatggtgcagtaccgcgagatcatgagcatggcctcctccatggtgagcaggtcgtcctcgaacatggccttgtgctgcatgtgctggctctgcttggcggccatcgcggccgcgccgtcgccgcgcagccactcgttcagacactggccgtcgccgccggcgccgctctcctgcgcgaaggtgttgcgcatggcgcgcatgagcctggcctccctggccgagcggctgagcacggtcatggggtcgtagagccaggggcctgcgtccgtgaacaggatggtgcagtacccgttggcgaaggcgtccgcgccgctgcagttgtcgatgccgtcgccgaccctgtagcacaccgcggagaccagccggtacatgatgccgttgagcatcatgtcctgcgacacctcgatgggaatgtcgctgatcacgggccgcatgttcgtgaagcagtcgcccgtgctggccatgcccccgcgccggttcaccaggaacaccagcacgccgttcgtgatcacgggcgcgcggtcgcgctcgtagaggtagccgctcgccgcgcacacggcggacgccacgtccgtgcgcgagaccgcgcccatgttctgggcgggcatgtacagcactcgcccggcctccgcggtgcacgagaagggctgctccccgcccacgtggatgggcgccgtcgatgtcgtgatcatcttgctggagtccaccaccaggtagggcaccgtgtgcatggccatgtcgcccatgcccccgatccccgttccgaacgacggccgcgacacgctcacgagcgtcggcttgaacgagactatggagaagatggaggccaagatctgctcctcgtcggtcatgatggaggcgcacgaggggtggatgatcttcattagggcgttgtcgatggactcgtcgctctcgcagtagaagacgcccatgcggaggttcaggatgcaccgccgcaggttggtgtgcagcaccgcgcgctggatctccatggacacggagtcgccgacgccgggcatcacgatgggcgtttcctcggtgagcttgttcaccagcagctggtagttgttgggtcgcacgcggctgttgtggtggagctgcgccaggagcgagaggctgtccccgttgacgaacgcggactcgatggccggcagctttacgccgaacagcgccatggcgatggggtgcacgaagcccacggagtcggacgacttgaacgagaagagcaggtcgcccgaggagctcatgtctttgaagtgcacggactggaactgcgtggcggagagcaagttctggtagctggacatgctctgcaggtcgtcgatctccttcatctgcttgtttacgcgggtcgagttcctcccgtagatgatcaccagcgggtgcgtctggctcacggatagccccgagtccgtcatggcggcgcgcacgctgttcagcagatcgaacagctccgaccggtctctgttctggatcccgacctttgccatcacagacatgagctcctggatggtcatgttcttgtggtctcggcgcgtggaccgcaggtagtcggcgatcatctcgccctccttacggatcttcatctgccagtcgtgcatggaggtcatgcggtccacaggcatgagcacgctgtcggaggacgactgcgcggcgctgccggactggcgcgagccagggcgcgcggacgacgggcgcgcggagctgccgcggctggaggaggacctggacctccgcgaggatcttcgctgcgaagagctgcgcacgggccgctgggcgcgcgccccggcggaaaccatgtcctcgcggtttatgctgaggagcgagctgcagaccgcgcacgacagcgactgctttggaatgtggatgtggtcgcactccagggacatgcccgcattgtcgtagcccgggaccaagtcgaactttgcattaaaaaaatctgatgcgcacgcgggcgattccatttataccggaagtttttatgaggtgccggtattatccacgcgatctcgcagtgtgctgggagactctagcgtagccacggaccccgtgagcagacgacgcaagtcgttgatggccgactgcgtgacggacttcgccgtctcgatgtcgcgcgtaaggctgagcgactcggcgttgaggtcgcgcacgctgtccgcgatgtcggccagctcctttttgatgaaatccttatcattatcggcgttgatgactttgtccggcactctagactctagaaccggtgacgcggcgggcgccttgatcgtcgggcagctggacgccgggtactggggcggcggcaatgattgctgtaggaagatgggcttagcggcaggcgccggttttgtcggcaagggcggcgccggcgggcactgtcgtgtagacggcgggcacgccggcgcggggcacgccgccggtggcggacatgtcggcgcagttgcgggtggacacgcgggcgcgggcgccggcgcgggacacgtcgcggcaggagccgggcacgcgggagccggagctggagccgggcacggcgcggcaggagccgggcacgtcgcggcaggcgcagggcacgcgggagccggagccgggcacgccggcgcaggaggacatgccggcgcagcggcaggacagaccaccgctgtcgcggagcacgcggcaaccggcgtggagcacgcggcgggcattacgttcagaggcgtcgactggaccttggcaccgcggggcagtagcgatggcgctaggggcgactgtccggtggttggacgctgcatgcaggcagtcgcagatttcagacgggactggtaatacctgcccgcttccttcaccgtgtacttgtcgacggagtctacctcctcatctggaggacatggctgctccggtgcgggaacgactgtttgaggacacttggtgaacagactggagctggtctccgatagcaccagtttagacttggccaagtcggaggcaaaccttcttctgagatccatttaagccttcaaaattgaacgtgtacgccgaccgctaaatggaagaatcggtggccgtcgagtacgcggacgaggacgaagatgagattgaggagtacgaggaggaggacgatgacgaggaggaagagtctgccgagggcgccgccgcctcctcggtcagcgacgtagcgctctctgccgccgagaagctggtggcctcggaggtcccggacgacgcggctgccgcggacaccaacgtgcgtcaacgcgtcaccgcgcgcgtggaggagcttaaggcgcgctacacacggcggatgagtctatttgagctcaccggaattgtagcagagagtttcaatcttctgtgtcgcgggcggctgccgctcgtggcggacgccgcagacccggcgctcgacaacgagctaaaagtggtggttcgggagctcgaggagggcgtctgccccatcgtcatcgagaaaaacggcgagttcctctcgccgggcgacttcgaccccgagtgcctgcgctaccacctgacgtacatgaccgacctctggaagtcccaggggcgcatgtagccgcggctacgccgactcggcggcctccgcgattttttcttttatcatgtccagcagctcgcgcaccacgatggggcggccgcagtacgtgatgccgttttcggatatcacgctctgtgcgatgtccaccagcgagccctcgcgctcccagtactcgcgcgcgagcacctccttgtacaacgcgcggtggttggccacgtaccgcaccagcgtctggatgttcttcacgcccacgctcttgaggtcctgcggcgagaacttctcgcgcagcgacacgaagacgtcccggacgagcttgccgatctccacgttggtcttgaactcgttgtacagcaccacgtagagcttgcacacgaccgtagcgaacttcgcgggcttgagatccttgttctggaagaccagcatgctgctcatcaccttcttcatgaaggccaggtacttcgcgcggtcgccctcgacgctcacgctcccgacctcgaggtcggacacgcagcggattccgtgctccgcgctctccgcggagacgcgcagcagctcctggtactccttgagcttctgcttgtccgtcatcagcgagttgtcgaataccgccaccagcttgagcacgtagttctcgtccgagaagaccttgttcagacacttcaccaggaagctgtagtggctctgcaggatcttcatgaccgcgttggcgccgctggctccgcggacgtgcgatatcatctccatgatcttcttagagtcgtcgatgatctcctcggtgtcgttgcgcatgttgcggtacattgcgttcagcgagaccagcgtctgcgcggccaggagcacgtcgcggaacacgcgcgcgaactcgcgcttctcctccgcgtcggtgatgctgttgtacacggacttcgccaccgcgttcgacttcaggaaccagaaggagagcgcctggtagttgaagtgcttcatcagcgccagcacgtccgcctcgctcatttccggcgcaatggggcacaccgagctctcgagcacgggcaccatgctgacgagcgtgtccacgtccgtgtcgaagtccaggcagtccacgcagagcccggtgccgcggctcaggtgatcgcggctgatgtcgtagaagcgctcgtagcaggtgcggaggcggtccatgtcggctgcgttttagagagacacacactcttgaattatggctgcgggtagaactcctgcagcagcgccggcgcacgcgcggagtccggctccactcccagcttcagcgcgcagttcacggaccaggtcttcatgaagcggtcgggcgcgtccgtgaccacgtgccggaagagcttcgcgaagtggcggctcacggcgttgggcacggtcgcgttgcgcacgaaggccgtgaagcgcgaggtcagcttcggcgcgaagcgcttgccgtccacgaagaagcccgaggtggtgagcgagagcccgttctcctcgcgcaccacgcgtcgcgcggccttgtgcggaaacatgctcgcgaggcgcccgctcgcgtcctggtctaggtggatggcgtccgtggccgcgtccttgcggatgcgcaccacgtcgtgcacgatctcctggatgaggatgcgcgtggccgcggtctccgccagccgcatggggaagtagaccatgtccccggagatgagcacgttcccgctagcgtttacgtagctcactatctcggacacggtgcgcagacgcacgatcgcgccttcgcagcagtgcaccacgtagtacccagcggtggcgcgcaggcgcttgttgtccgcctcgaagtccgcctccaacccctcgttgaagtacttgtcgaatatgatgggcaggaaggatagttttgactcggtgaccacctttccgaagttgaggatgtacgggttcagcgcgctgcggtcgacctcttcgtcgtacacgcaggacttgaaggtgtcggtgtgcgcctggctgcgcaggaagcagcacggaatgcagatgcgctgcaggcggtggaagatggagaggaagcccacgctgttgtagcgcccgtcggggtccatgcacgaaaacatgacgccgtttccgtttacgaagacctcgcgcgtctcggacttgaagaagttgttgctgaccttggccatgttcgcgtccagcgactgcacgatcacgggcttgcggttcttggtcttggtgttctggcagatgcgcgaccagtacacggtctccaccttggtgaagtccgaggactgcttcacgttgttgaacatcacgctgatggccacgatcaagaacgtgaagtacttctcgatgttcgggatgtagttctttaccttcacggacacgtgcgacttcgcgaggatgatcgagatgcgcttgtccgtggagagcaggatgttgttggtcgccgtctccacgaagatgaagctcgtttccatgtccagcttcatcttagacgtgatggtcgtgttcagcgacaccttgtaggtgatgtcgcccttgacgcggtccatctttacgtccatgctctcgatgagcttcgtgaacagactcacgtcgttcaccgtgagcgtcttcccgtcgctcgagatgaccaggtcgccttccgggccccacaccgagaggttcagcggctcgtccaccagcaggaagcgagtccccgtcatcgacacgaagaagtcgtccgtcttcgagagcaggatgtcgaagtcgcccacctccgctcgcttgtccggcgactgctgcgcgatcgcgcggagcccggactcgcgcaggttcgtgcggaagatgttgttgaacttggtctccacgttcatgtttaggtcgaggttcgcgaactcgcggatgagccgctcctcgaacttgaggatggagtcgttgggctcctcgaaggagccgaactccggcgcggaggtgtccgccgcgcgcgccacccagaccaccaggaagttgcacgcgtccgcgtacgcgttgtagaggatgccgtccgtgcggatgagcgttttcttttgcgtgggcgagaacgggttgaagatggtgttgtccacgtagctgtactccaggttgttcttgtgcgagtacacgatgatctcgtcctgcaggcccagcaggctccccaagtaccccttgagctgccgcacgcgcatggtcagcaagatgtgtctgcgcacgtgctcggggtccttctggatgtactgcttcgcgaagaagtagatcggcgaggcctcgtccacggagtcgtacagcgataggtacagcacgcgctcgatctcctggtggcgccccaccagcaccaccagctgcggcgcgacggtgtagagcatgttcgcgcgggcgtatttatagccggcgttaaactgaaataaaatacgcgggtcgcgaggcagcgccatgttccagccggtgcccgacatggccgccgaggccgacatcgacctcggcgacgtcagcgtggacgcgacgcgcgcgggcgcgcgcgagaagaccgtcttcttcgcgcgcaacaagcgcatgtacccgcaccgcagcaaggacgaggagcgcaagctgtcgctgggcttcttcttgcagcggctggacttcctcacgtcgcgcgaggtcaacctgcagttccggtcgctggacgcgctgcgcaccgagaacgtcatgaagaagaacaacgtgctcgtggcgccgtacatcctcatcgcgacgctcgcggggcgcggtttccgcatgacggagaccatggtcgagctctacttccccgagctgtaccgcgagaccagcaagcgcttccgcttctgcgcgcagataaaggtcatccaggacttcctggggttcgcccacgacagctaccacacttacgacttcgagacgtacttcgcgttcgtggcgctggtgctgcgcggcgcggactctgcggccgaggccttcgacgtccgcgccgagagcgggcttgtgcgcagcctcaccgagatcacgtaccggctctacgtgatgcagctgcgctccgacgccgcgcagtggagcgtgagcaccggcgccgtagtctcgcaggcggtgaacaccgtgctgtcggtcgtcggcgacctcgctgcgcgcgcggaggccgagcggctcacgcccgtgtgcgacctcgcgcgcgagaacccgctctcgctcgaggacctgcgcaagtacggcccgcggctgcgctcgctgctcacgaccatggcgcgcgcgcgatccttcaagacgaaccggcgggacaaggacgcgctgtcccggttctgccgactgacggcgggccctagcccgtctgcgtgccgcgcgtcgccataggcgtcggcgcgcgctcgccgccggaacactcggggtcgctgaacatgtagatgagcgcgacgcctagcagcaggtacatgatcatgctgatcacggttttgaacacgacggcggcgaacgtgttggaccgcagtcggtgctcgcagaagtgcatgaacaggtgccgcatgaggtcgatggccccgttggccacctggaaaagggcgaggccgccgatggacttgatcaccgtcacgtagcacggccgcattccgacgacgctatttactcactgtcaaaagaaacggcgccatccgaccggaggttgaggttgcgcttcatgttgttccagtacatctcaccgatgctcgagtagtacgccgtcagccgcgatattttttctcgcaccagctcgtaggccttctgcatctccgcaacgccgatctccgcgtcgcccacgtaccggccgctgcggcgcacgatcagcagcagcgccttcaggttctccagcgcgatcatgtccatgtacagcgacttcgagagctgcacgaagaggttgtaccgctccaggatgctgttcttcacctcgtccgcgatcgggactccgaagatgcgctccgtggtgtacacggactgcgtgagctgcttgaagagcgcggagatgcagcaggtcgcgcgcttgacggcgtcgagctgcttctcggagcgcgcgctcgcgatgctcagcgcgctgttcacgacgttgctcgtgtcgcgcacgtagcgcgtcttcagcgcggcgttgatggcatccgcgatctcgttgctgctcacgctcgagtcgtccgagctgcccgagacctcgtccagcagccccgagatcgtgatgtcgggcgagccgccgacggtcaccagacggtcgagcaggttgcagggcatggacatgaggatgccctcgctcgagaggcagccctcgtcgatcatgctctgcaggttgcgcttgaaggccgtgttttcgggcatgaacccgtccacgctcatgagctcgtcgaccgtgctcgcggaaaagatgcccctcacgttgatgcggtccagcatgcccatgtcctgcgagcacagcaccaccgactggtcggccgtctcggcggcgtccttggcgccgccgtagatgatgcgcggaaaccgccagctcgccggaaaagagaaggagggaaaccggcactgcgcgctcgggcctcggtagccctgcgcgtcgcgcacgttggtggccgtgaccatgaactgcagcaggtcgtgcgcggacgccatgatcttctccacctcctccttgctgcagcagaccttgcccaggctgcgcgcgatgttcgttttgctcactgagggcgagaccgtgacggcggtgtgtcggcggctgccgagcgtgtacgcgctcacgctaacgcggtaccccatggcgccgaagagcagcttcacgaagtccaggtagctctccttattgatgtagtgcggcgcgcccttgtcttccatcctcagcccggcgtaggccatgagcacttccttcatcgccgtctcggggtccgagttgcacaccagccgcagcatctggaagaactgcatgaaggcgcgctgcgagagcccgatgtggtggttgggctgcgtcgaccggcgcgggaactccctgggcgtcatggcgttgatgcccgagagcgtctccatcacgagcgcgcccacggtcttctggcccatgacgcgcgggtaaaagcacacgcggaggggctccttgccggccgcgagcgcgtccgagagcagcgagcagtacgtgacgttgtcgtggtcgaagagcgcgaaggtgtagcagacggagctcatgaagagcgagtcggcggtgctcatggacttgaactccgtgtacgcgattccgtcccagaacaggctctttccgggcgcgatcagcggggacgcgcggtcggcgcgcatcagcatggagagcagcgtcacgtagtaacggatgttggcggaaatgtctacgaactgcatgccgggcgaggccacgcgcagggtcgcgcccgaggtagtgagcacctccaggctgtccatgagcgtcacgctggggtgcagctgcgcaaggcgcgccagctggctctggtagaagatggacacggcgaggctggccacgctgccgcgtgccatgcgcaggttttgcccgttgaaggtgagctggcgcagcgagaacacggagtcgaagtactggaagaaggtgagcaggtacttgagcggcatggtcgtcagctcggtatccacctgcggcgtctgtgcgagcacgattccgttcttggccgcggcgtcggggatgtcgtacatggcgtccattctggcgcgggaggcgtcggtgagcagcgcgcgcacgttgagcagcatgagcaggtcccgcgctagcatggtcccgtcgaccagccgggcgcgaaagccgatctcggcggggccggcgatgttggggtagatcaggttcagcaggtacgtgttgtcgaagctcagcgaggggaaggagatgggagacttcgccgggaggccggtggggtagcgcacgtagccgccgcagatgcgcgcgtgcgcctcaaagctggtcacgcgagtcttcagcaggttgcgggtgaagggcggcacgtccttgaaggactgcgtgcagatcacggggttggcggtgtcggtcagcttgaggttggtgggcttaagctccgcgaagttggggcccagcagcacggggacgaggtgcgagttggcggcgctgtcgagcaggaagttgatgccgaactgcttcacggcgacctcggtttcctcgtcgctggcgagcttctccgcgtcctcgaggaagagcgcgtccagcgggtgcacgtacgtgcggttgacgtcgtagctgggcttgaagtccgaacacagcgtggggagcacggtggagacgagctggaacatgtattccgcgccctccacatggtgcaaggccatgtgcacgtttggggccgtcatttatttagtattaaatgacggccgtaccggtaaccgatattcctggagactacgggccgacgtccttttcggaggacaactacccgctgaacaagcactacgagctcaccaaaggccagctctcgatcctgcgcacggtcaacgacaagctgctcgcgcgcaccgtgcagcactcggacggggagagcgatgagagcgaaagcgaggaggacgacatctccagtccgctgccgccggacgaggaggagccggactcgtgcgtggcccgggtcatgccgcgggacgcggacctggcggcgccaaaaaaggccgacggctacatcattgccgccgagcagcagcgccagcagcgcataaacattctggtatccgatcgagaggccgtcgtggagcgggagccggttcagacgtcgttcgcgcgcgtctcggctatcccgatccacggggacggcgcgcgccgcaccaccgcctccttctccgcgaccacgccgtcgctgggcgccgtgttcgacgacgccaagcgcgtgcggctgctggaggaggaggtcaaggagctccgcagaaagtgcgcgacctctcaggataacggaaacctggagaacttcaccaaggtgctgttcggcaaggcgccgcgcgcgagcgagctgaacaagcgcgtggtcatcgtgaactacgccacgctgaacaacgtgacgctgtccatggaggacctcgagaagtgctccgacgaggaagtggaccgcatgtactcggtcatccggcgctacaacgagacgcggaagaagaagatcctggtcacgaacgtggtcatcatcgggatcaccgtgctcgagcacgtgctggtgaagcttggcttctcggaggtgcgcgggctcagcgccgacctctcgtcggagctcatcgacgtggagatcggcgaggactgcgagcacatcgcggagcgcctggggttcgggaacagcccggtgctaaacgtggcgctcttcgtggtaaagctgttcgtgcggaagctgaacctgatctgatcaacacatgccgccgtcgaggtccatggcgttcatgaggttggaggcgcggcggcgcgcgccggtggaagcggtggaggcgctcgaggtcgtggagcagggagtgttgctggaggaggcgcggcggcgggagctagaagcggaactcgaggttccgctggtggtgctgcggcgactcgtgccgctcgtgccgctcctgctagtgccagtgccagtgccgctgcggcgtgaagtaccggtgccggacctgccgctggagcttttcttgcggccgccgttaacgctgtcgatgccgagcaggtcctcgcacacctcgccgacggttccctgcacgtccaacttgccgttcttgacaaccccgtacacgatcttgccgcagttggacacagcctggatggtggtctcgtcgctgtcaaaggcgttcattccgccgcacccgccgtcgttgtttcttcgagaaggcgcgccgctgcggcgactcctggtgctgccgctggaccgagttccggaggacctggagcccgtggaccggctgccggtcgacctggtgccggtagtgcgctttctggacgaagaggaggaggcgcttccgcggcgggtggacgaactagcctccagcgcaccggcgccgcccacacaatccacgtcggcggcggcgcctccgcgaatgacctgctcgttgttgagctgcgtcaggagagatcgcagctgcggcgcgatcttctgcaaggtgctcacgtagtcgtcgtagctgctctgcgggcgctgcgccattttttcggacgccatttattacgcggaatatctacgacgacgcagcactgaatcggtttctcgcgacgggagattccgcggtcggcgccggtgcggggttgtcaccgggcgacgaggtaaccagcgcgtggaaggcgcgcacctggtcgtccgtcatcttgtcctcgaacgaggacgcgcccggggggagcaggtccttgttgcgcggaacggcgggcgccgagacgcacgaccggcggtacatcatgatgacgatgtagcacacgatcgagatgacgatcacggtcagcagcgcgtcgaggagccccatttattacctgtatatgcccgcgtttaccgggcggtgagctcaatgtcggtgttgtttagccgggcgtacgggacgctgccggagcacttcctgtacatgctgaacacgaacagcccgagcagcagcacggcgcccactatgaagcaggttacgcacagcgcgcgccacacgtagtcggtgacgttgttggtgttcttgctgaaatccacgaaggcgaagacgcaggcggccgtcagcagcagcacgccgcatatcagcactccggagtagtaagagctcaaggtctcgaatatgtccatttatctgaggagaaatttaaattactgaatggacgaagtggaatagaaaccacgagaacacgacggactgcagcacgaagatggtgctcagcttcgtcttcatgggcatgcagaagttcgcggccagcgccatacagaagatgaacacgagcaccgccgggtcgtagtcggacaccatttacactacgctaaaaggcatatctcggcgcgcgacgtccacgagcaccagcacgcggacgcccgcgggcgcgccggcggcgaccgcggcgagctgcccggccgtggggttcaccagcagcagtgcgcgcgcggttcgcgggacggggtcttcgtaggccatggtcggcgtggacccgggacgcagcggccgcccctgtctgtcgaagaggccctcgggaaacgaggtgcccggaacggccacgacgacggtgtcgctatctagaaacatttatggtcttggtttccacggatcgcctcgagtagaccgccacgaagtagaagatgacgcccgccgcgagcgccgccaccaggaagggcggcacggcgggcaggttcgcggacgcgttgtcgcgcacgccggggtccgggtctgcgtagcccgcgcccacggccttgccgcagtcggcgatcatgtgcgcgcgcgagttctgcatgaccaggctgtccacgtcgatgcggcagcccacgtagcggcaccgcgagcgctgctcgtcctggctgaagaagagccacttgcggtcgcgcgactggtccgtgcactcgtgcgcgcgacagacgcgcgggcccaggtacttcccgagcgtggtgcccgcgacacacgcgcactccggcgcggcgcggtgcgcgtcgcagtagcgccgcagcgcggagtcgccgaaggcgaaggaggcgggccgcgccacgcgcacgaactccgagcagaagcgcgcgtccatgtgcttggcgcagagcgccgcgtaggtgtccagcgccgcgtagcggcccgtgcgcagccaggccatgcactcgggcgcgtcaggctccaccgcgcagcggctggccataacgccgtcgcagtgcgcggtcttgtacccgttcgcgaacacggacgggcacccgggctccggatttgtgcagcagcgcgccatggcggcgtccgtgggcggcgccgaggcgccgatctcgaacgcgcacatggtgccctggcgcaggtacggcttcgcgatctcgggaacgtagtctgcgcgcagcagcgagcccgggcggaagaagagcgagtcgcagggcgggcctcgcacgagccgcgcgcggctcgccagctctggcgagaggaagcgcccgcactgcccggggtccatggtcggcagcagacagaaccgcggccgtacggtcttcagcttcgggtcggagaaggtttctgattcttccgcgaaggcgaaggtgtccgtggcgctcgtgtgtgtgacgcgcagcgcgtactcgcctggcgtcggcgtgtcgagcacctccaccttggatacggtgtcccccatttgaagacgctatttacgccgctgcctactcggcgaagaataggtcctccgacttggcgcccgcgtacaccgggcaggcgggcgcggcggagcgagtgcgcacgataccgcggccagtgaggcggaaggcgtagatggcgaacagcaggccgagcacgatgtacatgaaagtggtggcgcccacagacccggtcacgtgcgtcacgatgatggtgacgatggacatgatcgtgcacacgatggccatgccggtgttgttggccgcgtaggggtgcatgatctgcatggccgcacagtatccgatgaccaggcacggcagcgggaggataagtgaggcaatacctatcattactagagcgagcacgggggtggacgtcaaggccaatacaaaaatcacaatacctgttagtatgcggatatcctcgtactggaggacgctgtaaggcgcgatattccctccgggcactggcctggggttagccgggactaggggggagtcggcagtgccggggtccttggggagaaaggcattctgctcctccgggctgaagagctcggcgtcctgaacgccgccggcggtgaactcgtcgttatagtaactaaagtagctttccatttatatgttgaaaaatgtttggaggcgtacaggtggacgacaaactctacgcgtacctaaaaaaactcgccggacgcgggcggccgctgtgtctgttccgcgacaacggcgagttcgtcgaagtcttcgcggggtccgcgttccgctttgtgctgcccgtgggcctcttcgcggacctgcgcgtgcgcacgcgcggcgtggccttcccgaaactgcgcgactccgcgcgcatgcgcggcgtgcgggtggacgcgcacacgctgccctcgctgtaccccaaccagcgcatcgtggtggacgaggtgctcgcggcccgcgaccagttgctggccgcgggccgcgccgtgtacgtgacgctgcatctggcttgcggcttcgggaagacgctgaccgcgtgccacctcatcgccacgcacggccgccgcgcggtggtgtgcgtgcccaaccgcatgctggtgccgcagtggcgcgcggccgtggcggagctgcgggtgcccttcgcggtctcctgtgacggcgcggcctcgctgctgcgctcgggcgagctcgaccgcgccatggtggccatcgtggtcagccggcacttcgccaacgacgacttctgccgcgcggtgagccggcagtttgacgtgctcgtgctcgacgagtcgcacacatacaacctcatgaacaacaccgcggtctcgcgcttcttgaccaagtacccgccgcccatgtgcttcttcctgaccgcgacgccgcgcacggccaaccgcatctactgcaaccgcgtggtgaacgtgtccgtggtcagccgcctcaccaaggtagtgcgcgtggtggacgccttcttcgagccgtacaccacgcccaagatccgcacgctcgagcgcagcctcgagggaccccagaacaagtaccacgtcttcaccgagaagatcctcggcgaggacgtgcaccgcaacaagctcatcgtggacaccgtggtcgcggccatggccgcgggcgaggcgcggcgcgtgctcgtgctcaccaagctgcgcgaacacatggtcgggctgcacgccgcgctctgcgagcgcctcggtgcggagacggtctttctcggcgacgccaagaacaggaagacgcccgaggtcacgcgcgcactgcgcgacaaggaccgcttcgtgctcgtgtccacggtcttcttctcgggcacgggcctggacctgcccaacctggacgcgctcgcggtggccgcggccgtgctcaaccgcatggtcatggagcagatgatcggacgcgtgtgtcgcgagtcgcacgccaacacgcgcacgctgttcgtgttcccggactcctccgtgcgcgcgatccgcgacaccgtgtctgcgtttgcgcagcggctcgtggcgctggcggtggacgggctgggcttcgtccgcgagcgcgccgccgccggcgcgaagaacgagccggcgctgtacagcgccatcagcgggcgagatctcgcagcggtgtaagcgcggacccgcacgccgcgcacgagagcgtgctggagcaggcgagtcccagcgacagtgtggacagcctgtccacgtccttgatgctcaccagccgcgagttgcacgacgagcacacggggtcgctactatcatcgaccaccgtggtgacgcggcggcgtctgcgctttttgtttccagcggcgacatcgaccacgcctcccttagagccccccttcgcccccgccttagctttcaccgcgctcatcttttatttatcataaaaacacgtctgcgtacgcgttcgcgcacacgtcccgcaaatccgcgcgcgcgccgcagcgcgtgaagcgcgcggcgtccgcctccgcgatccgcgcgcacggcagcggcgcgcccttctcgtccgccatcacgcgcgcagagatcccggtggcccccagcgcgtacgacaccaccacgtcgccgacgcagcggtacacgttgccggagccggcgaggcggtcgaacgcggcgccctcctggcgcagcttgtcgaatatgcgaggaacgaggatgttaaaaatgagaacgaaatagcagatcagcaaaaacagcgagatcatgacctccgagagcgatttatataccttgaaagagctaatacgacttcgggactcgctgcacctcgccaccggcgccgccgtcgagcgctacaacgcgctcgtggagtgggccgcgcgcacgtactggacggtcgcggtgctgccctccgcgccgtgcgcctccatcgagaagtactactgcgtgtgcaaacccgactgcgcgctcgagcccggcgagtactccgtgagccggctgcacttcggactcacgcacgcctgggtgcgcggcgccgccttcaactcggccagcggcgccgaggtcgagccgccagaggaggtgcgtagggcctgcgaggcgctcgacgccgccttcgcggacctcaccttcgtgcgcttctcggtcttcggccgcgagtggacggtcgacgacgccgtcacagaccactcctcgcgcgacgaggtgctcgccgcgtgcgccgcctccggcgtgcgcgtcgcgcgcacgctgcgtgtgcgcgtgcgggcgggagagtccttcgcgcgcgcagacttcgacgcggtgcacgccgcgctgcgcgcggagggcgacgtcgctcgcggcaccgcggtctgtctcgcgctgcgcgggtcatcgcgccgctggatagcggaccgcgcgcctcgatgcttcatgcgcgtgcgccgcgtggagctcgagcccgtggacgcgcggcaccactgcccggtgctgatctccgcgcgcggcgaccgggtgctctgccgcggcgtggggcacctcgcggacgcgcgcgcgcgcgagggcgtcttcgtggccgtgcgcaggtacccggagtgtctggtgctctgcgacgaggcggccgccggcgcggcggagtgctcgcgcgaggaggcgctgcggctgctggtgcgccgcttcgggcgcgacttcgccgtcagcgaggagggctacgtcttccgcgtgcaggacatggacttgcgcggcgtgtccgcgcgactggggctcgcgccctgcgcgagcctggaggagctgcgccgagcggtggagcgcgaccgcgcgctgatgaggcggctgcgcgcggagggcgccgtgcgcctcgcgtgcgagtgcgtgggatacccgcgccagaacgcggtggagctcataaataatatgcgctttcaaataacggaagaaggcgcggtggcgaactttgagctggcgaacgcgagctgtctcggcaacccgaccgcggagtccatcttcgcgagcttcgcgcagttcgtgccggtcttcaacgtgctctcggcgatcgcgcgcgcgcagccatgatcgtggcggccttcgaccttggcacgcgcaaccccgcgcgcaccgtgctggaggtgctcgacggcacggtgcgcgtggtggacgtggccaagctggactggagccgcgactgggagaagcgcgtgcaccgcgacgtgaccgccttccccgcgaacgtggtgctcgtggagcgccagtgcaagatgtcgcctttttctaagttcatatacttcatacgcgggctgctctacgacgggcggcgccgcacgcgcgtgctcgcggtgccgccggccatgaccggcagcacctaccggcagcgcaagcgccgctcggtgcgcaccttcctcgcgctcgcggagagcttcggcatcctggacgccgtgcccgcgcggaagaagctcgacgacgtcgcggacagcttcaacatggccatcaattacgtgctccgaacaaactgaaatacgactggaacgaataagtcatgctggcgctgttcgagttcctgcggtccgtggaggactgctaccggcgcaccatcttcaacttccacatcgcgcacagcgccgaggcgggcgatgtctacggcgtgctgcgcgaccgcattttggcggccacgcgcttcgaggaggtagcgccgccagggctcgcggacgcgctggccaaggtggtctactgcgacataagcaccaccaagcacctggtcaaccacgcggccttcgcggcgcgcgcgcggccggcgcggcgcggaggcagcctcgcgcagttcttcgacgtgcacgtgggcgaggacgcggagagccgccgcaccgcggagatcttcgaccgcgagcgctcctcgctggtctcgtacgtgaagaccacggccaagcgctgcaagatcgactacggcgagatcaagcgcaccatccacggcgggcggcagacctacttctcggggcggcgctcggacgacttcctgagcaccaccgtgcgcgcggacccgagcaagccctggatcaagtccatctccaagcagctgcgcgtggacatcctgcaccacgcgatctgcacgcgcggcaagagctccatcctgcagaccatcgagatcgtgctcacgaaccgcacctgcgtgaagatattcaaggactcgaccatgcacataatcctctccaaggacgaccgcgagcgcgggctcgcggacctcgcggacaagctcttcgggacctacgcgaccaccttccgcgtcatcgcggccatcaccggcaacgcctgcttcgcggcggtggcggacgcggccgcgcgcgtggtcgcgctcccggacgcggacgcgaagctggcggcggtgcgcgggctcgcggagtgctacggcgtgcgcaacttcaaaatcggcatgttcaacctcaccttcacgggcgccatcgagcacacggtcttcccctcgctgatccccgcggagagcaagatcaagttcttcaagggcaagaagcttaacatcgtcgcggtgcgctccaccgaggagggccgcgagtgcgtggagcaggcgcaggcgctgctcgcggccatgcgcgagcgctccgcgcggctcgcggccgcggacgtggccaccgcgagcgtggacttcctcaaggagctgctggggccatagtgaaataatactgatttcttaaatatggagcaggcgctcggatacaagtttttgttgcccgaccccaaggacgacgtctactaccgcccgctccacttccagtatgagtcatacgccaacttcatcaagcaccggcttaaggacatcctcacggtgcggcgcacgctgctcaccttcaagaacggcaccgagtccatcgtgctcgagatcgacgacgtgaagatctcggcgccggagttctcgcccatcgtggccagcatcaagggccacagctacgaggcgctggtcaccttcacggtgaacatctaccggcacgtgatgaccaaggacggcctcaccgttaccaagatcaacagctacgagggcaccgactcgcacctcgtcaagctcccgctgctcatcggctacgggaacaagaacgcgctggacccctccaagttcgtggtcccgaacgccatcggcggcgtcttcatcaacaagcagtccatcgagaagctcggcatcaacatgatcgagaagatcaccacctggcccaagttccgcgccgtgaaggccaactccttcacgctctccttctcctcgatctcgcccgtgcacgtgatgcccgcgcggtaccgacactacaagatcctgctcgacgtgaaccagcccgacaacttcgtgatctcctccgcgaagaccttcatcaccgtgaacgtgatcgtgatggtgcagttcctcgcggacgtcacgctcgagttcgtggcgcgcaacctctgcttcgacatgccgcccgaggccgcgcacctggccaccgcgctcgtggagagcgcgaagaccgtgcccgcgggcgcggacgtggccgagtacgtgaacgcgctcatcgcggccgagcacgcgaagcagaagtcgacgctgtccaaggaggagttccgctacgagatgctcagcaacttcctcccgcacatgcaggacagcgccaaccagctcaagggcctgtacctgctctcgctggtgcgcaagatggtcttctgcgtgttcttcccgaaccggtacccggaccgcgactcgctggtctgccaccgcgtgtacacctacgggcgctacttcgaggcgctggccatggacgagctcgagacctacatcgggaacatccgcaacgacatcctcgcgaaccacaagaaccgcggcacctgcaccgtgaacatccacgtgctgaccacgcccggcttcaaccacgccttcgcggcgctgctcagcggcaagttccgcaagtccgacggcagcttccgcacgcacccgcactactcctggatgcagagcatctccatcccgcgcagcgtgggcttctaccccgagcaggtcaagatctcgaagatgttcaaggtgcgcatgtaccaccccagccagtacggcttcttctgcgcctcggacgtgcccgagcgcgggccgcaggtcgggctcatctcgcagctctccgtgctcgcctccatctcgaacatccgcaccgcggacttcgtcgagctcaccaagcgcgtctgcgactacgtgcgctcctaccccgcgcgcgacatcagctacttcgagaccgggttcgcggtcaccgtcgagaacgcgctcgtggcctcgctgaaccccgcgatcgtggacgcgttcgtgctcgacctgcgccggcgcaagcggctcggcttcttcgggaaccgcgagatcggcgtcgcgctcgtgcgcgaccgcatgaacgaggtgcgcatcaacttcggcgcgggccggctcatccgcccgctgctcgtggtcgagaacggcgtgctcgtcatggacgcggaggcggagcggctcgagcgcgacctcgccgcgatgaccttctcggacgtgctgcgcgagttcccgcacgtgatcgagatcgtggacgtggagcagttcagcttcagcaacgtctgcgactccgtgcagcgcttccgcacgctgccgcccgaggagcgcgcgctcttcgacttctgcgacttcccggccgagttccgcgacgggtacgtggcctcctcgctcgtgggcatcaaccacaactccgcgccgcgcgccatcctcggctgcgcgcaggccaagcaggccatctcctgcctgagcgcggacctgcgcaacaaggtcgacaacggcatccacctcatgttcgcggagcggcccatcgtggtcagcaaggcgctggagacctccaagatcgcggacaactgcttcgggcaccacgtcaccatcgcgctcatgtccttccgcggcatgaaccaggaggacggcatcatcctgaagcggcagttcgcggagcgcggcgggctcgacatcctcacctgcaagaagtaccaggtcgagatcccgctcgagaacttcaacaaccgcgagcgcgtgcgctccgcggcgtactccaagatcgacgtcaacggcgtggtgcgcctgaacgccttcctcgagcagggcgacgccatcgcgcggaacgtgtcctcgcgcacgctcgacgacgacttcgtcgccgacaaccagatcagcttcgacatcgcggagcggtactcggacatctacgccgcgcgcgtggagcgcgtgcaggccgacctcaccgacaaggtcaaggtgcgcgcgctgaccgtgcgcgagcgccgcgccatcctcggggacaagttcaccacgcgcaccagccagaagggcacggtcgcgtacgtggccgacgagactgagctgccctacgacgagaacgggatcgcgccggacgtgatcatcaactcgacctccatcttctcgcggaagacgctctccatgctcatggaggtcatcctcaccacggcctacgggcacaagcccttcgccgaggacggctccaaccgcccgatctgcttccccagcaccaacgagaccgacttcgagacctacatcgagttcgcgcggcgctgctacgcgctctcgcaccccgaggccgccgcggacgaccccgagttcgagcaccgcgtcttctgcgagcgcgtgctcttcgaccccgagaccgacgagcccttcgcggcgcgcgtcttcttcgggccgctgtactacctgcgtctgcggcacctcacgctggacaaggccacggtgcgctgccgcgggcgcaagaccaagctcatccggcaggccaacgagggccgccgccgcggcggcggcatcaagatcggcgagatggagcgcgactgcatgatctcgcacggcgcggccttcaccgtcgccgagatcctgcgcgactccgaggaggacgcgcaggaggtgctcgtctgcgagaactgcggcgacatcgcggcgcggctcaacggcacgcacgtctgcatccgctgctccaagatgagcctctcgccggtgctcacgcgcatggactccacgcacgtgagcaaggtcttcaccacgcagatgaacgcgcgcggcataaagatccgcgtggagttcgagaagcaggacccctgcttctacgggactccgaaacggttcagcctcgcgcccgacgagtcgctgttctcgccggaggactgaacccgccgtcgcgaccgcgtcgcgacgactagcttatcgttcgactgatgcgaaacgcgcggcggcgccgcgacttagcttatctcgactgatgcgaacgcgcgacctctcgcgactttctagcttctcagactgatgctaccatatcgcggcgtgctggccccaccaccagggcttctcgccgtggctgacgcggggctggctgcgacgcgcgctgcagtagctgcgcgcgccccagtcgccgcgcacgtgcgccgggggcaggctcccgtccagcgcgtgccgcgtcacctcggcgccgggccggcggcacgtgtgcacgtccgtcttgttggagacgagcaccgcgtactgccgcatggtctctatgtgatgctccaagtgcttgcccgccatccggttggactcgcagcacgtttttgcttcggctaaggttttttctagaggggatagtagcttatccacgcgctcgggcaggacgcacgcggagccgtcgaaccctactttgaacggggtcaccttgatgttcccgtcgtagcggtcccacagcatcctgaggtaggttgtaccgtcggggtctgggtctgtccacactctaagcttttcgctacagcggccgtcgtacgtaagacggtctctacgctcgtagtagtttctgcttatgttgttggggtctccatgctcgtagtagtataaatcgtacgcgcctggcttttttaagtcgttttcgtcgttgctgacgtgtatcacgtcgggataataggatatcctaactgcactacaatctatagtatttggtctagtaagctgttcgagatcaccttgttcatcatgatctactgatttgtacacggcaccgtcgtgttccgacggacgtatgaatatgtccatggtaaacgatgtacccactttggaaaacgtatcccatgcagtaaagcatagtccgtccattataaactcaggaacactcataacaaatcgaaatctgtgaagtttttcgaacaccacttttacatggtctttgtcacgaacatcattgccgtttacttcagacatgaattgaaggaacgctaaagagtttcttgtttcttcatgaatctttccattatacgtccatccagtttctagaattctatatatgctttttgcatcgaccccgtaccaccagtacatgggaactccgaaatatatagctgggtttgagtaccaatgggcaagagtgcccattgcgtttaaaaagtcttgacaaaaaaatgcagtttttctgtcgataacttgacttggactacgttcgtggacatcgtacatgtccataattggttcattggtaacggttacatgacccgtcattatctttttaacaatcataagatacagtttgcctaaagtcgaaatatgtataacgttaatttttacatgttctcctaacgtaattgcgtttttacttagccattcgtcgtctacaaaaatcttacgatacataggatttctctctacgtatcttctaaagtatagatttaccggtctaccggcgacattagcgccatctatagcaggagcaagctgtatgtatcgtcgtataatgtctcgtataagctttctgtcttctctgggaatacacgacacggaacttagagactggtgccagtgtctttcaaccaaagacttgaacctagcaaccaacgcgttgtcactctccatttataattaaataattatcccaacttcgtatgttaatccttattaccagatagcaccgctccttcctctccaccacgtactatctaaaggatacctgtaagggtaatgtctggataacgggcgtgtgagccaagacgtgttatggtgtcttccccaccaacggtccacttctctaactaccggagtgctagacgttgtcgatcccactactgttgtttctccattacctgtaatctttgaagcgcaacaagtgttagtctttgccaaatcttctaacggcttaattaggtcgttaagtctgtcaatatccatgcactgaggtgtatcgttaccagtttccccaactttgggaggaacttcctgtttagtgtccaaataacccataaacctgtctctaagcattcttctgtacgtgcttttgtcattgtctatgtctcccaaaaacctgtgatttacgcatccgttgtacgtaagtctgtcccttcgctctcgctcgttatttcctacttcttctattgtactgtaatgttgatagtccaagtaatagccactgttttcatgatttcttgtaaatataatcggtgttttattattgacatcgtgttgcctactgtacgtatcttccatggatctaggaacttgtctagaaaattgaggactagaaatacgccttccaaatcctggatgataaaccaaacgcaatgcactacagtcgacatcgtcactgtctctagttatcccatcaacaactccttctttgtgatgctccactgttttaaagttaactcctctgtatatgttgagtgttaaaaaaatatccacattgaacgcagttccatattttgttattttatcccacgacgtataacacaaaccatccataatgaattccggaaccgatactacaaaattagtatcgaacttatcaaacgaaatgtttactcgcggttgtgcttcgtattttttgtcatacacatctgtcatgtattgtacaaaatctatagctcctctagcatcgggcatgctaacgtctggaaaatcattttttaactgttctagtacgaactgttgattttggtcatctctccaccagtacattggcaatcctatcacaagagacttatttttataataatttgctacagaagctatatgccacatgaaattatagcaaaaataatccatctgtatgtttaaaaccggtttactagtctgctgagagtagctatccatgatagtgtttccctcgccaatacttcctgacattattctgtaaacaaccattaacaaaaatcttcctaccgttgttatgttgtcaaaagttcttatgttttgagcactttcgagtaaccatatgttattttcaaatatacttttgtaaactggatttctgtccacataactctttaaaaatagatttactggaaggccgcttgggttatctccctgtataggcggcgcttgctttatgtattcgcgtaacaaatctcttacaacttttctagttcttctaggtatacatgacctattattcaaaggctttgtccagttagcgtttataaacgttgtaaagtcactgactagcttctccatttataattaaataattacagacggcaacacagcggttatctaatatctgctgtatcctgtctgtacatctatttttctgttgagatcaagaagagctttacgtagactctccaagtgtctttctagtctgtctaaccggttacctgtttctctgcagcaatcagttatagttttgtaactgtctaacaagcttacgaggcgctcttccacactttctttagttggagctccagccgcgtacactccgttggttgaattgcctgtatcatcaggctgagtcaataggttttctccgtcattttcatccatattgagtccaacgaacacaaacgagtaagtgttcctctatttaaagtattgattttagaaaaaggcaagcctcgctgccctgattcggcggcaaacacgggttgaacacgcggaagtcgctcgcggccgtgaagatctcgtccgcgcacgcctccacgctcgcgaagcgcccaggcgagacgccgtcgtgcgagcggaacccgaactccgaggccgccaccgccgcgcccttgaagagcacgcagcgccacttcttgcgcacgtcgaaggcctcgtcgttggggtcgaacacgcgccggtccacgcgcgggccgcccgccgtgcgcgcgaactccagcgccgcgttcgccgcgttgaactcgcggatgttgtcgtagttctcgtagacggcccagagctgcagcgccacgaacatggcggccgccgccgcgagggccacgcagagcgcggacaccgcgtccatcttttatgtgcagaattattcgttggcgcggagctcgcgcagctccgcggcgcgcagccgcgcgaaggctgctttgagcgcgcgcagcagctcctcggtgtccgcgcgcagcatgtcgaagcggtggtagctgtccaggcgcgcgcggcagccgaagaagcgtgcgacgcacgcggtgacgatgtcgttcacgtagagcacgcccgaggccgtgcagtacacggagcgcggctcgcgcgggtccggcggcacgtccacggcgaccgcgtgcgcggccacgtcctcgagcaccttgcgctcgagcacggcgaggaagtcgcgcagctggcggcggttgtccagccaggcgtaggtggtcgcgaagagcgtgagccgcccgcgcggcgcgatcgcggtgtagggcgcgtacccgcggaactcccgggggtgcacgaccttgacgttctcgtgctcgcgacggaaggcctcggtgtcgagcagcgccgcgagcgcgtccacgagcttgtcggagacctccacgcccgcgccgaaggcgatgagctcgatcttctgctcgctcttggggcggaagtcgtggaaggtgtgcagcagcatctcgcggagctgcggcggcttctcgacggcctcgagcgcgtcgccgcggacgaggaagtagtcgaggtcgtgcagcgagacgtgctgcccggcggcgctctgcacaaacttgaggaagacgcagaggcccgcgcggcgctcgagcacgtcctcgacgtgcgcgtggaatacgtgccgcgagggcatggcctcgatcgcggagagccactcctcgttgacgcaggtggtggtgttctccagcaccacgccctgcgtgagcgcgggccactgcaggtggaaggcgaactcgtgcttgatgagcgaggccacggccgggtccaggtccacggccagcgcggcctcgccgacgaggggagcgtccgccatcacgcggaggacgcctggcccatctcctttttcgcctttttattcaggatcattattctttcgttgacgaggtccatgagcatcttgatggcggcggccgcggccgccgcgtcgccgccgcacatctgcgcgatgcgcgtgagcatgtgcagcagcgcggcctcgtttaggtcctcctccatttagaggccgtgagggcgcgcgtcgtcgcgacgaggggacgcctcccgcggcagcgtggtgcgcacggcgaaggcgagcagcgcgccggcgcactgcgtgagcacacactccgcgagcgcgacgaggagctcggagggcgcgagcaccatttagaggcgcgcgcgggtttaattgccgccgtcagagtcggcatcatcgcccttgtcgccgccgtccttgcagtcgcccttggtctcggcgtcgacgatgtcggcgagccgcgtcttcatgtgcgagaactgcgcgagcaggatgccggggtcgagacagcgcttgacgacgctctcgtcggcgaagtcgtagcagatgcgctcctggttctggcagaacaccgagtcttcgatgatcaacaccctcctggtcccggccgaccgcatgatggccatggcccggatgagcctcttcttcgatccgcgtatggacatggaccggagcacgttctccacgtcggagtcggagacgttgcagcagcagaggtgcgtgatgctggcgcgcccgttgacggggatgtgcttgtaggtctggcagagcagcaccagcgacacgttgatgtgccgcccgtagttcatgaggcccaagagtgtgggcgaccgcgtctgcgtgtcgcccatatcgtcgagaatgatgaggaacttctgcttcttcgtctgcgcgtgccgctcgatcttgcgcttggcgaccgagaggttgtactcgagctcctcgtgcgtggtgaccttgtggatgtggtccggccacacgaagccgtcgtaggcggcgttgtagacgggcgtgaagagcaggatgtgcttgaagcggcgcacgagcgtgcggaagagcgagagcaggtaggcggtcttgccggagccggagccgccgacgagcgccatcctgaagggcgcctcgatgagactctcccgcttgaagcgcacctcctgcacgacatccatcgtatatttactgtcactaaattaccggctccgagaaatatagaaattagagcctcctagagcacaccgaggcgcatcggcaagatggcacataacacgttcgaaaacgatagcgagtcggcagctaacaaccagtacgtggcgtcagtcaagcgccagaaaatgattcggcgatacattaagatgttcttccggttcgttacggcgatagctatcattgtcctggctattctagttgtgattctgtcgctatctctagacgaatgtctgcacagagaacaccctcatgactattcacatgtacaaaattcaacatgcgacggcattactttaggtggtgaaaagtgtctcagacttaatttgccagcaacgtgggaagatgctaatagacaatgtggtaatcttgggttttacctaccatctactggccttgaaaagaaatttccttggcttgtgacctatctcgacggaacttggggaaacactcagaactccgtatttggaccaaccggtgacttgcagaatgtcataggaccgaaagaatacaaatatttttgtgtgtccgattagatgattataatctaataaatgggttgctgtaaggtccctaaccgccagtctataaggactttgaaaaaggcgtcctgtccggtcgccagtctcgtcaccattctctccctagtcaccagcctcggtgcgatagtcagatacaccaatttttttctaaaagaagcatgtgacgaaggatggatgcccataaaaaacatatgcattttaaacacgcactttgaagccaccaatgacgatgcccacaggatatgtgaaaacctagacggaaagccgccggccatccctaaccctactctgttaaagggtgtcacagttctcaccggcgaaaagaaattttggatgacccatcacgaagactatactactgtgtttgagcatatagacgataggacgactcctaaaaacacagactatgacagtaaaaaacacacttgtttgatgagcgaggacggattgatacaccataactgcatgatgaacgtgactgtggtatgcatgaaggagatgcacggataactgaaaatatactgtttgaacgcaaagacgccatgtcgcgacttcaaatactgacctcatttggacaaatcttcgcacccgacgaagctcggctgcgcgagatcgcgcgtgatttgggaatatgcaccataaaacgcgcattcggcgacatgctgtacggctttatagacttcgacccggtgcccctgacccaagtaaacatgctcatgtccaactgctacttcgcggtcaacggcaacctgcttccgtgcacggaggacttccggctcagactcccggcaacggagatctctgcggcctacctgacgagaacgggacggacgatcctgtgcggcaaagacttcaacatagtagcgccgtcggggttcaagccgtccatgcggctgcgcgacctcagtcacgtgtctgcgcttgtagagatcctggaagtctacgacgagtccggggagtaccaattcgtgctcggccccagcgcgcagttcatgctgcggctgatggagaaggagaacgtctgtctgttcggcagcgggtggtgcatagtggacctgcgcaagctggacgtacccatataatcagcatccttgtttttatcctgtctttttatcagttttttagctagttaaaacataaatagtaaagctaaaaagaggagttctggagtcttgcaacaaccaggatgaaggcggtgttgttgctggcgttactgggagcgttcaccaacgcagcgcctttgttagaaagccagcgttctaacagtgaggaaaaagcaaatttctgctcgacgcataatgatgaagtgtacgccaggttcaggcttcagatgcgcgtgggtgtacgacacagtccgctctacactcccagcaacatgtgcatgctggacatagaagactccgttgaggacatagaagagtccacagaaaaagaatacgcgtctacggccacgggtgaggcggccggagtgaacgtgtcagtggcactagtgggagaaggcgtgagcataccgtttagttacataggccttggattcaacccgtcgcttgaagatagctacctgtacgtcaacgtctcgtcacgagctccttgggttaaacagacttcggacctatccgcgaacggcggctggggtatcaaacaggttctagaaaaagagttactggccatccaaatagggtgcgacaaccaaaaatttcccgaagaacccacaactacacccccctcacctgtcactacaacgctttcctcaacaactccagatctgaatgaagaaaacacagaaaatacgccgacgaccaccggcgccagtgtagacagaaagcgcaatccagctgacattgacttctcgctgctcgtggacccccgatgcgtgacctctgtagacctgcacgtcgagctcagggacgcgtgcatagactacaaacaagagtcgccgttgtcgctgaaggggaaatatggagacggcgaactagtaaaaaaggagattaaagacgtgggaaagaatcacaatatgtgcagtcttaacctcaaccctggcaattgagctgtttttattcggcaatataataggtgattattgaacattaaacaaaacttatcccacaacgccgcaacaatggaagtgctggtgatcatctctattatcgtcgccgtaatatgcttgaccggagcggtaatgtacctccttattgaactcggcttagccgccgagcgcgctaacaaacgcgcgcgcgtgaagaaaaatatgcgcaaattagccactcaattgggaaatggatctgtcgactccggcataggcataggcccgtgcataatgtcgcgcaccatggactctggacccagtcgctgggacagcgacagtgaggatgacggggacagcctgtccacgacgtccaccagcggaggggggactctcacccgagtgtgggttgggagcgccgggcctatgtacgaaaacttctgcgggaacggcacccgccactcccccaccaacgaccctggctaccactcgcgggagactctctgcagcggacctccccgtcaggcgccggcgctaccgcccaccccgaagcccgacgaggtaacggtggacgtggggcccggtcccgacgaccaacacggtccgtacgaggaacctgatcccattcccccgcaggaacccgagccgccggtgcagattgaggtaaccatcaacgggcccggtggagaaggcgaggcggaaggagaatttttctacgacgagtagccgccaaaactgaataactatcgggcttcgtaaacgcgcagacatgccgctgttccggaagctcatggtttcgcgctccctggtcaaggaatgtctgactctggacttccggcagggcgagcgtctccctacgcgatgcttcctcccggtgcccgcggggacgacattccacagagtctgcgacacctcgccgctgacggacgaagtctcccggcacgtgcaggagcccgtcatgggcaccggacgggtccagtactactacttcgagagcggccagggcatgatcggcgacaacgcgggcatggcgcgcatgctcgtgtgcacgcggtcggcgtacaacggcggcgacgtcgtcgtgcggtccacgcggagcagagcagacaagaccgtggtcgcgccctgccagggcatggcgctgctgctgagccccttctgcgccttcgacatcacgccggtcgagagcggctccgcgatattcgcggaggtcatcgtcaccgcgcccagcatggactacgtcgaggcggtcaccggcacgggcgaggcggccgtgcggatattcaactcgcaccacccgctctggccgcgacacggctcgaacgtctgcttcgcgctgcggttgctgcgagacgtgcgcacgggcgagcgcgtggtcgagcagatgttcatggacgggcgctggcacaccgtgctgaggacgtcctgcggcaacaaggtctgcgtgcccgccgacctcgtgggccagacgaacctcgaggaggtgcccttctgcgacgtgacgcccgagatcatgcgccgcgcgctggcgatcgacccgccgtacgaggccgtggcgcacccgcaccgctgcgtgtacggcgccatggacgtccggtgcgcgaacgagtacctcgtgtactgcaccttcaagacggagccgacacggcgcagcacgtcctcgccgggcccggacagcccgctgtcgcccgcgactccgtcgacctcgcgggccgcggccgcgcgcgtccccacgacgccgcaggaagtggcctcgccgaccacgaggctcctggagacctgtctgcgcgacgccctcgacggactctgacccgaaggacccaccgtccactcacattccactgccagacaactcaagctttttctgcatctacctcgctaataattgaattgttataggacaaacaggcgcactcgagcacaatggcgtgttttatcgaattgttagactccatcttcaaccgacgccaccgtaatttcgggccggaggacatgtacaggccctctgacgccccgccccccaaatcgcacacgcctcgcactccccgcaccccgcggacccagtgtcccggacacccgcggcgacaaagctcctctcccatctacggcgcttatgtggactccctgccgaggaacagaaagcggttccagaatcaacacagttgtcccggagattacgagcggtgtcaactctcggacaccatcagcctggatgcgacgctactcacggttacagtgacgtccatctccagcatatccagctctagtagctcagactctatctctctggggcagtgcagactgtccatggtgtccgcaacatcaacctccacctccacaaccttctcctcctcggaatgagcgccacacttatttttgtataatagtttgtattgaaccttagagacatccacaaatagttaggaagcatgagtagttcaagtagcgagaccacccctaagcccaagcccatccctgctcctcccatgactcaggaggagtttaacaaagaagtgaagaaacgaaaagaacagaaaaaggaaaaatctagaaccgttgaacgtgagtcagaaaccgtaactgtatcttccgacggatcagagataaaaaagacttacgagcgcgagtctgagagaacaaccgaaacagaaaagaacaacacgtcaaccgatgataataagcagaacacccctgtagagaaaccagaggaaaccaagcctgcttctactcctgaaggtgtgaagccagccgagactcctgccccgactactgacccccaacctactacacaaccacccgcagaatcaaaccctggaagtcaacccgcacctgcttcagaaccaacccccgcacctgagcctgcaccggaacccactcagcctgcatcagtaactcaacccgctccaacaccagagccaagtccagcccctaagcctactccggcttctgaaccaaccccagcatctgagcctacttctgctccagaacctacaccatccgcagaaccaactcctcaaccaactgtagaaacaccaccatctgctccagcaccaactcccgaggcccaaccacccgccaacagcaatcccactactgaaactaccactggtaccagcacctcctaagtgagtacgtaagcatttcggagtaacgtcgtagcaagcgctagtccgccgcgagcggttctcgcaagttttttcgggtaaaaagcgtacaccgtcgccttgtcgcggcggtgtacgcttttttcacgccctttttgcaaaatttaaattgtacccgcgccggctctaggaaagatggcgtgcctcagagtgttcctggcggtgctcgcgctgtgcgggagcgtgcactcggcgcaatggatcggcgagcgcgacttctgcacggcccacgcgcaggacgtcttcgcgcggctgcaggtgtggatgcgcattgaccggaacgtgaccgccgcggacaacagctcggcctgcgcgctggcgatagagacgccgccgagcaacttcgacgcggacgtctacgtcgccgcggccggcataaacgtcagcgtgtccgcgatcaactgcggcttcttcaacatgcgccaggtagagacgacgtacaacacggcacgccggcagatgtacgtgtacatggactcctgggacccttgggtgatcgacgacccccagccgctcttcagccaggagtacgaaaacgaaacgcttccgtacctgctggaggttctggagctagcgaggctgtacattcgcgtgggctgcacggtgcccggagagcagcccttcgaggtgatcccggggatcgactacccgcacaccggcatggagtttctccagcacgttctacggccgaaccgccggttcgctccggcgaagctgcacatggacctcgaggtggaccaccggtgcgtgagcgccgtccacgtgaaggcgttcctgcaggacgcctgtagcgcccgcaaggcgcggacgccactctacttcgcggggcatggctgcaaccatccagatcgccggccaaaaaacccagtaccgcgccctcagcacgtatcgtcgccgatctccaggaagtgcagcatgcagacggcgcgctaagggcgctcaccgcgctgacggcggccgtggtgtgcgcgatcgccatcgcgctcgagcgcggggcggaggccgacgccgtggaccttatccttataaaattttcaatgatatgctagtttttatgcgaccttccttagaaaattcggaattcaaaaatgaaataaaacggcgtttagcacgcatattattaataccgaccaccatggcaggcgtccgcagctgccagaagaaagtcccttctactgcgggctccatgtcatttcaacggggcaaccggagcatccagccggcgatgtccgaggcgttgcagaatgatttcagctacaacccgcgaccgcctccgccgagcgcagaagagattgacttcttctgcgtggacatgcgcaaagtactgatggaaattgaggccaagcccagcagctccaagtaccccgatttcatcacccggttgacagcagcccgccgtgcacgccggcgcgcaagcgcaacggcttcggccgcaaggcactgaacaaaacccaggtgccgcagcaggccaagcgtgacggctactcccgctaatgcagtccacacacttcacacactacatcagcactcaagcttataatcactacacaatgaatcagcccaccacgtgcgaagcacacacataaaatcacccacctgtcctgatcgttcccaatactcccaatcaccgtgctttacacgcacgttaatcaccctttccttccttcatgcgttcctgatcgttcctcctccttaatcacacacacaccccgtaattttgtacttttgtactttaatttgtacactttacacactgactttgtactgcctttgtactttatttttgtactgaaattggacgatacttatctttgtattcacatccaagttttgcaaattccacagccggtagcgaaaagtgaaatcgtaccgttttaggcttcgatccccctcccgcgcgaagactcgccagcatggactctcgtaggctcgctcttgccgtcgccttcggaggcgtcctcgccagcatgacacagcgccgccgcctggcttctctcatcgccagcatcggccaacggctgatgggcggcgacggcatgcgtcgcgtcgccgttcggttgatcgaccagctcatggccggacccccggacatcaacgacgaggccttccagcgcgagatccgcgtgggcgagctcttccaggcgctccaccgcgtggtcgagcaggcacgccgagagaagtacttcgaggtctgcggcgccggcaacgacgccgacgcgcccgtcgtcgagatggacaccgcggccgcacccccgcagccccagcccgcgcccctcgtggtcacgccgcagaacgcgttcatgttcgtgccgcaaggcagccacgtgcacgtggacgagagcgtggacccgttcttcggcatgagcccctccatcttcgggcgcgacctcccccctcagccgcccgaggagctgctgagcgactacgacccgctcatgagccaggccggcgagccgccgagcccgcggtcgccctgcgaggccgacctctggtgcttcgagacgctcggcgacagcgacagcgattgagaccgcaccacaccctacctcacccaccccacactccacctcacctcaccctaacacccaacacccaacacctcaaccggacaatgaaggagtcccacatttcactgaaggacgcggatgaagccgcactcccccacatgaaggattggcaacggtcaaacatttcacctgcaatgaaggacgatgcgcggtcgcattggcctgcgaccgacatcgcacacatgaaggacacaattggtttgttaatccggacaatgaaggacaaattgtttttgttaatcaggacaattagaacacaatcaaatttttgtacgatcataaaatcgatatttgatgcacatatattagtaagtatattagactaaattctccggggaggcaagcagttggatacggcggggcggggcacgacgtgcacggagagttcgggcgggtcccccttccccccacccccacgcaccacgatgcgcctaatcttagcgctcgtggcctgcttgttggcggcgccgatgccgttatcgggtcgttcgacaagcactccaaacacgtccccctccgcactcggctcgacgagttcggaaccaagctcggaagacgctgtggcttcgagcacaacgacaagcacactcacaagcactacaagcacactcactatgtccacaagtgtggacaccactactacctcgggcgctacaacgtccgcaaacagcactcctgcagcgagtgtgagctcctccacacccgcaactaccgaggcatcgacggcaccaacgacgccgtcgacgccgacgacagtgaaggtaacgaagggcaaggaagacacgaaggcgtctgcctacctcgttttactaatcacgttcatggtcatgaccacgctcgtgatggtcgtggtcgtggtcgtggtcgtgtacaaacagggactctgtaactgctgctgtaagtttccctgctgcaaagagctcaaggactacctcgacgaggaggagagcgccgggctgtacgacgccttgacgtggagccactcagactccggcctccggctcgtcgtgcgcgcggaccccagatgatgaggatcggataagatcggcgtgtttttcccgcccgtcgcgaacattatgcctctaaatgccgagaattaactgaaattcaaacacgctttgggactcaactccgtgacccacactcaaccatggctggcttcctaggcgcattcagaggcgtgtgctccgacttatggcagtcgctccgtggacacggacaccactcttccagctgcccgcgacgacgcgccaacagcatggacgaccgcgaccggcgccgacaccgccaccgcgagatccccaacagctcggcgtcgctgaacagcgacccgatgccgcaacgcagtgcgggtgcgcgccggcactacgactgccgcccctcggaaaagagcagacactcctccgacaagcaccactcggcggaccgacaccactcggcggaccgacaccaatcggcggacagggacagacaccgtcgcagtcgcaagaactacgactcgcacccgtcgcgcaggaaccgcaactacgagcgggcggactaccagagacacccctcacaaacccacccagacgcccccgcgcagacctcgacgctcaaggtgacctccctaagcaccagctgcagcaccctgtcccaacatcactacgagacccccgaccacatctacgacatcccggaagacagtcgcggggcgtcggctccccctcgcgcggacctcgcgctccccccgctcgccatgcccaaatccaagccgcgtcgcacgcgcccggcgtccatgaacgactgcctgatgaagcactgcggcgccggcagacccaacctccaagacgacatatgcacactatgtactgatatagagacacagctgagcgcactagagaagtctctggagtcagagctcaacttctatcgtcgctacatacaagacactaagacattgctcgccacgcgagcagcaaacatcggcagcaaagctctgatctacaccgacgactacaacggcagtggcgacgtcggcgaaaaggagcactgctcggaggagtgctgcaaagtggaggaagttctgtgagaaagtgcgtttttctgtaatgtgaaataagatagccttatgtgtgcacagacatggcgaacaggctcgtgtttctcgaccccgagaccctagccgaggccgacggcatccccggctatggggtgttcgagcccggcaagaagaaatgcatcttcacaaagatccgcaccagcgtcgcactcgcgtgccggtacgccgtctcggacggcggcctcatcgacgagttcgtcatggctacatacgggaccagacgcgcgtgccggctcgtccggcacctgacgataggcgcggagggcgtgatgacccggcccgccagcaactgcgcgccgcacatggtgctcatctgcctcagaggcgtggccgccgtgtccagcgaggacatgggcttcggtcgctgcatcatggagcgcggcaccatgttcatggtcaagtccgcgcacagcgccgtcgtctgcggcaaccccgcctgcgagctgctcgtcctcttctacgactacttcacccccatcccccggccgctctccggagacgaggtgctgttcacccgcgacctcgcgcacgtggactacgcccccgagtcggcggtcgtcttcaagatggattacaacctcgagaccgacgtggccacgctgtttgtcggggggtacatattccgcgccaagggcctgatgatggagacgcgcgaacaagtgggcgacgagtgcgactgctgccgccacagctcgccggtgctcgtcatggatcgcgagaagatgatgtcgtcgctgcgcatgatccccagcatcgtgcccggccagcgggagatttggcttcgcgagcgcggctgggccgtcctcgagacggacgcccgcggacactgcgagcccggcgtcctgaggctggcgctcgccggcctgcggctgttcgcaggatgcctgcgctccgtcgtggggcggcgcgagctgtcgctgttctgctacggcgtcgctcccaagttcggcggggagttcgaggacgcgccgcgccccatggagatcgacggttagttgtttttatccctgtacatacgccgcaaactgaaactttagggcaccgcgtaatagtgcacgaacgcccagtggaccgcttccgcagccatggaaaacaacgacggcaacgaacgcaacaacgaacacccgcacgttcgagaattcaaggaggcgtccctgtacgggtttctggtggcggccgcggacgtgaccgtcgaagacgtgcaccggtaccttcagttcggcgcggacgtgaactacaggggcgcgtacctgtgcacgccgctgcacgcgtacctgcagtccggctgcgaaaagcgcctagacgtcgtggacgcgctgctggacgccggcgcagacatcaacgccaaggagatctgcggtctcacgcccgtgcacctgtacgcgagctacgcggacgtggacgtagagttcatgcgcgggctcatcgagcgcggcgcgagcgtgtgcggcgagagctcggtcacgggctgcctgtactcgtacctgtacacacacagcgtggacggcggcgcgcgcctggacgtggtcgagctgctcgtgcaggcgggcgcggacgtgaacgtccgcggcgaggcgcgcaagacgccgctgcacgtgcactgcgcgggcttcgaggtggattcggacatcgtggatctgctgctgcgcgcgggcgcggaccccgaggcgctcgacgaacacgggctcacgcccgcggacgtgctcgtgaagtccgtgggcgccaacgtggagacgctgcggctcttcctcgacgcgggcgtgagcgtggccacgtcgcgcgacgcgcgcggacgcacgccgctgcaccaccacgcagactccttccgggcgagtgcgggcatcgtgcgcgaactgctcgccgccggctgcgacgcggcggccgccgacgacctcggaaacacgcccctgcacagcctcgccaccttctgctcgtgccggcgctcggtgctcgaccagctcatcgccggcggcgcggacatcaacgcccgcaaccactacggccacacctgtctgtactacgcgtccatctacaacccctccgtctgctcgcggctcatcgccgcgggtgcggacgtgaccgcgcgcacgccggacggacgcacgccgctctcgggcatgatcatgcgcaagcacacgcgcgccgtgcgcgccgccctggcgacgcggcctcccgcggacgccgtcgccgcgtcgctggacgtcgcagtacagcccgagcccacggacgccactcgcgcgtgcgtgcggtacgtggtgctctgcggcggcacgctctcggcgcgcgtgcggtcgcgacacgcggacttcgtgcgagagtgcgaaagcgaggtggtcgtgctcagaaccaccgtggtggggctgcccggcacctcgctgctggacatcgtgcgtgcggcgcagccgccgccggtactgctctccccgcgcgtgcaccacgtgctgcagaagctgtgcgtgtacgcggagttggtggacgcgcggctgcgcgagatgcggcacaagaccaacctcgtggacgcggtgtcgcggctcgtgtgtccgtgcgcgctgccgccggaggtggtgcgcggcatcctcgtgcacgtgccgatagacagcctgcggcacacgttgaccctcggcgtggcgcaggcctcgcgtttccttccctcgcataaatgaaatattattttttgtggtagaccggatctccccgatggaccccgccggacaacgactgcgcgcgccagggccgtggcgcctgaacccgccgaccgcggccgcgctggaaagcgcgctgctgcggcccgcggcgtcggcgggcgccgaccgctgcgcgaacgcgcacgtggaccgccgcaacatgggcgtcggcgagggccgcgaggtgcccgcggacgtcgaggggctcatgaccgagatccacctgcggtacggaatgacgcgcgtccaccggaacgttcacttcgtgcagttctggcacggcgagcacgtgcgccggcgccccgcgcgacacgtgttcacggtctggatctgcctcagcggcgaggtgcgcatctacgcagagtgctgccaggcggggcacggcttcgtgctctgccgacagatggcggcagggtacatgttcgtgaccgaacccacggactcggtcacggtctcggtgccgcaccgactgcgcaactcgcggtcgccggtgtggctggcggcggtcttcgccacgcggcacttcgagccgctgccgccgcccatgtacgccgtgcccgggcacgtggtgctcgcgcgcagcgcctccatgctctgcgactgctggccgtcggacccgcggcgccgcaacgtgatcttctacatgcggctgtcgggcgcgatggtgcgcgtggtcgtgccgggcgcggagctcgagatcgagtgcacctcggggttccggccggaccacttctccatcaacgacgagtgcgtgtgctgcgagcgtccgcacgtcgcgcgaaccgcggtgtggacgctggcggagatttgccgcggcgccacggtggtgctcgcgccgccactgccccgcgaccgcgccgcggggctgctcgcggagatccgcctggcctcgctgcgatgggtgcgcgtgcgtgcggtccgcagcggcagagaaagcgtgggcccgttcccctcggtggtgtgggcggcggtcttctccgccgttcggctcttcctggacggaaccgtgcctgccttcccggcgtgtgtggagaatggacgcgcggcgtacggcatggtgtacgtgcccccggaggagccgcggatggacgggctctgtgtgttcccgacgcccgccgagccggcggcgctcttcgtccgcggagaccaggtgcttgaggccggcgcggccgccgccataatcgcggccgctgagaagcgcgtccaggccgccaatgggtctcctgctgccgcggaggaggacataggtgcggcggccgatgccgccgcagagagcgtggagcaggaccagcgcgtcgagttcgaccttgggcctgggcctgaccccagccaagaagcgcccgcggacgcgcagcgtgccgattcggacgacgacaccggctccgagaccgagaccggcgacgagagtgtgggcggcgaggatgacagcgactcctcctcctcttactcggtgatgtcggacgacgaaaacgacagcggcgacgagggctggggcgactctagcgactccggcatcgaggacgacgacggcggtgtcggccaggccgccgaggaagaagaggaggaagagcgcgacgtcctcggcgcagcggcccagatgctcggagactgaccggtggtgaaaacataaaaataaactgttcaacacttgtactccgggcaccaacactactatccatacccaccctccctccacacactacaatggcaaacagagaagagattgacgcctccgccgtcatggctgcctacctcgcgagagagtacgcggcggctgtagaagaacagctgacgccgcgcgagcgcgatgcgctcgaagcccttcgcgtttccggcgaggaggtccggtcgccgctgctgcaagaactctcgaacgcgggcgagcaccgcgccaaccccgaaaactcgcacatccccgccgccctcgtctccgcgcttctcgaagcccccacctcccccggccgcatggtcactgcgattgagctctgcgcgcagatgggccgggtatggacgcgcggccgccagctcgtcgaattcatgcggctcgtgtacgtgctcctagaccgtctgccgcccacggccgacgaggacctcagcacctggctgcaggccgtcgcgcgcgtgcacggcacgcggcgccgcctgcaccgcgttctcggcgtcggggccgtcatggcaggcgtcggtatgctgctgctcggcgtgcgcgtgttgcggcgcacataactttttatctcggctcaaactgaaatacgacattggactacgaaacctatgattttgctcacggccgcgcgagataggataataaataacctttgagcaactaacatggccgatgagagagaggccgacggcgcgctgttccggtacctggagagcgaggaccgtccggacgtggagcacatgcgccggctgctggacgagggtgcggacgtgaactacgcgggcccgcgcgggtacgcgccgctgcacatgctcatgcgcggcaacccgctagaccccgacgcggtgcgactgctgctcgccgcgggcgcggacgtgaacgcgacatcgctctgcgggttcacgccgctgcactcctacatgtgcttcgggaccgtgacgccagacacgctgcgtgcgctcatgcgccacggcgcgagcgtcagcgacctcgagcgcaacatcaacgcgctgatcgagtacttcaaccgcgacggctgcatgggcggcgcggaggcgaccgtgatcgcactgctggtggagcacggcgcgcacgtgaacgccaaagacgaccttggacgaacgccgctgcacatctacctgtccggcttcttcgtgtcggcaccggtggcgctcgcgctgatcgcgctcggcgcgaacccgaacgccacggacgcgtacgggcgcacgccactgcacgccttcctgcgctcccgcgacgtggaccccgctgtgctgaagacgctcatcgccgcgggcgcagacccgctcgcgcgcgacatcatccggcgcacggcgctgcactaccactgcgagtccttcaagacgcgcgctagtgttatagagacgctggtggccgccggctgcgaccccgcgagcacagacctgctcgacaacacggcgctgcacagcatggccatgggcagctcctgccgcgcctcgctgatccgcccgctgctggccgcgggcgtgtccgtgaacgcgcgcaacgcgcggctgcagacgccgctgcacctcgcggccgtgttcaacccgccggcctgcgcgcggctgctggccgcgggcgcggaccccgcgctcgcggacctggacgagacaacgccgctgctgagcatggtgcggcacaactgcgcacgcgcgctgcgcacggcgctgcccttggcgccggacgcgctggtggccggcgcggtgaaccgcgtgaacgcgcgcacgccgagcgcggccacgcgagagtgcgtgatggcgctggcgctgcgcggcgcgctggacctgctgagcgcggagagcgttgccacccacgcggccgcgatccgcgcctgcgaggcggaggtcgcgctgctgcggcgcacgcgcctgggcgcgccgccgacgacgctcttcgcgctgctgacaggacgaccgaacacgctggtttccgcgaaggcggcgcgacgcgcgatggcggacgtgtgtgtctaccgcgcggcgctggccgcgcgcgtggagcgcgtgcgccgcaagtcctcgctggtcgagcgcctcaccgccatggtgtgtccgtgcgctctgccgccagagctagtgacgcgcatcctcgcgctcctgaccgtggaggaactcgcttgcgcaatgcgcaaataataatgaactataactaggcttattagaggcactatttgtgcagagtcgttagttatagttagtgtacttacaattggaatgtcgaagaacaaaattctggtgtgttttgtaattattcttacttatacattatacacagatgcgtattgtgttgagtatgaggaaagtgaggaagataaacaacagtgcggtagtagtagtaattttcctgcgagtttaccgcacatgcttagagaactcagggcagcgttcggaaaggtaaaaactttcttccagatgaaagaccaactgaacagtatgctactcacacagtcgctcctcgacgacttcaaaggctacctcgggtgtcaggcactttctgagatgatacagttttacttggaagaggtgatgccgcaggcggaaaatcacgggccggacatcaaagagcacgttaactcgctgggagaaaaactcaaaacgctgcgtcttcgactgcgtcgctgccaccgcttcctgccgtgtgagaacaagagtaaggccgtggagcaagtcaaacgtgtgttcaacatgctgcaggaacgaggtgtttacaaggccatgagcgagttcgacatattcatcaactacatagaatcatacatgactactaaaatgtaaaaatgtatacaacttttagttatcgttcggattctcgtatcgttctgcatactatgtatataaaatgtatattaacatagttacagttacagttacagctatatttttatgctcacaagatgctatataattgaaaggaaattgttcactctctgtcagggcgccatggactttctaggcgccgcgcttcacgactacgttgccgatgcgcccaaggtctgcgccgaggaggtgcggcggctgctggccgcaggcgcctctgtggagtacgcgggcgagttcgggaagaccgcgctgcaccagtacatgggccgttccggcgcggaccccgccgtcgtgcgcgcgctgctggacgccggcgcgcgcgtggacctcccggagacctgctgcggctgcacgcccgtgcacctctgcctcatggccgccaatatcgacgtggaggttctccgcatgctcgtccacgagggccgcgtcgaggactgcggccgcgccgagctcgcctccgtggtgctcaaggagttcgtggtgaaccgcgccttcgacgagaacgtcaccgagcgagtgatgcgcgttcttgtggccgcgggcgcggacgtgaacgccgccagcgtggtcgaccgcacgccgctgcacgtctgcctcacgggcatgtccacgcacccgggcaccatcgccgcgctgctgcgcttcggcgcggacgtgaacgccgtggacctctgcggcatgtcgccgctggcggtgctcgtgcgctcgcgcgcggcgaccgcagagctggtgcgcatgctgctcgacgcgggcgcagacgcacacgctgtcgacagtcgcctggactcgctgctgcaccagcactttcagtccgcgcgcccgcggccggaggtggtgcgcgagctcatccgccacggctgctcgccgcgggcgcggaaccgaatcggcaacacgccgctgcacgaggccgcaaaacactcctcctgcaaacactcgctggtggggccgctgctggctgccggcgcgagcgtggacgcgcgaaataacacgggcaggacgccgctccacttggcggtggcgtccaacccgcgcgcgtgccgccggctgatcgcgcttggggcggacgtggtcgcgcgcagttacgcgggcgtcacgccgctggcgcagctgatcgcggacaataactccgcgctggtgaccgcggcgctgaacacgcagcccgagccgcgggccgtggcagagtcgctgcgagcgaccacgcccgtcggcgagacagcgtgctcgcggctctgtgtggcgtacgtggtggcgcgcgcgccgagcgaggtcctcggcgagcccgagcgcgccctgcacgcggccttcgtggcggagtgcttagcggaggtagcggccatacacgccgtgcgctgcggcacacctccggtctcgctgctggagatcctggtggccgcgcgcccgccgcggagcctgctctcgcgccgcgcgtggcggctggccagccggacgacagtttaccgcgcgccgctccgtgcacgcatcgcggccatgcgccatcgctcgcgactggtggagcgcgcgctgcgcacgctgcgcggctgcgtgctcccgcgcgaggtgctggagcgcgtgctgcggtgtctgtccacacaggacctgcgggcctccggactggccgagtagctttttctgagataagtgaataaacatggtgggattcgatcgcgccgccaacgccacgccatggacgccgccgagatggaggatctcgacatcaacgcggagtcggcgctgtacgactacttcatcctgaacgcggacagagcccgcgtgggcgaggtggttatgcttctcgcacagggcgcggaaataaactacgcggacagcttcgacaagacgccgctgcacctgtacttgcacacgcgacacccgcgctcggacgtgattctggcgctgatggaggcgggcgcggtcgtggacacgccggagcgctgctgcggcgcgaccgcggcgcacctgtacatcctcaacgcggccaaggtcgacctgtcggtgctggaggccatgctgacctggggcgtgcgccagaacgaccagcactcggagcggctgctctcgagcttgttgcgcgagtacgtggtgacccgcgcctactcggatcagaccgagccgatcatggacttgctcatcggcatgggcgccgacgtggacatgccggtcggcgtgagtcgcacggcgctgcacgcctgccttacgggcctgaacgcgaacccgtgcatgattcgcgcgctgcttcggcgcggcgccagcgtgaccgcaaaagacacctacgagatgacgccgctggcggtgctgctgaagtccgcgagcgcgacgccggagctcgtgcgcatcctcgtggaggcaggctccgacgtgagcgccaccgacttccgcctcaacggcatgctgcaccagcacgcgcagtccacgcgcccgcgcgcgagcgtcatgcgcgagctcatccggctggggtgcagcccagcggccaaaaacatgtttgggaacacgccgatgcacatgctggccatggaaagctcctgccgccgctcactgatcctcccgctgctggaggcagggctttccgtgaacgaggagaacccgcactacggcaccgtgcctctgcacgtggcctcggggtacgacaacacgcagggctgcctcaagctcctccggcatggaggagaccccaccgtcgtgtcggccgccggacgcacgccgctctcgaacatgctcgtcaaacgcaaccacgtggcggtcgccggcgcgctgtcgacgcacccgagcgcggcagtagtcgtgcaggctctcgagcaggctctcgagaacgtgctgaacgccgggcccagcgaggcctcgcggctcgccgtggcctttgtggtggcgcgcgccggcgcatccgcgctaccggaggccgtgcgccgtctgcacgagggctttgtcgccgactgcgagcgcgaagtcgagctgctttcccgcaccatgctcggcacaccggccgtgagcgcgctggtcgtgctggtcagcaaggaggtctttggcactgttatctcctcgcgtgcgctgcgcgtcgtgcgggaggtccgcgtgtacgcaaggccgctccgcgaggcgctcataaatctgcgccacaaatgccgcttagtttccagccttaaaaggcaggtgggaccttgctcgctgcccggcgaactggtggagcgcgtgctcgcgaccgtgccactgaccgacttgcgccgctcgtgcggccgccgcgcgcccgagtaactgcccgtcccgttgctacgcgactcgagactgcccgctgtttttctttccccgtttcttcttattaggagttgttgcccgcctccatgatcctcgcacgcgccggcgggcaacctcgcacgcccgcggcggccgcggccgccgccgaggacggcgagcacagtgatcgccggaagcgcaagcgcaagacgcccaactgcgaagacgccgacaactccgacgacgagctagcgcagacgccgtgcgaccgcgagtggccggactgtcgcgcgagctcgatcacgagctccgactcggtctctctcggcgacgagatctacctgcgatacgtggcctcgcaggtggacttcgcgcagacctgggccccgccagtgcggctgctgcgcttcttcgggaacttctcgaaggaaacgctcaaccgcatgtcgcggcgcgggtacgtgaaccgctcctacttccagatggcgcacgcgcgcttctcgcccaccaacgacgacatgtaccacatggccacgggcgggtacggcatcgtgttccgcttcgaccgctacgtggttaagtacgtcttcgagcaccgcaacggcatgtccgagatggacgcctctacggagtacacggtgccgcggttcctgcgcaataacctcaagggcgacgagcgcgagttcgtggtctgcgcgctggccatggggctgaactaccggctgggcttcctgcactcgctgtaccggcgcgtgctgcacacgctgctgctgctcatgcgcgtggaggaaggccagcggccctcggtggagatgtccaagaagccgctgctgcgctggttcgaggcgcgcaaggacagcgagtccttcgtgcgcctgatctcgtacttctacccctcggccgtgcagagcaacgtgaacctgatcaacaacttccaccacctggtgcacttcttcgagcacgagaagcgcgcgcggtacgtgttcgaccgcggggccgtgatcgtgttccctctggcgcgcgggtccgcggactcgatctcgccggaggcggcggcggcgctgggcttcgcgccgcactcggagttcctcaagttcgtgttcctgcagatcgcgctgctgtacctgaagatctacgagctcccgggctgcacgaacttcctgcacgtggacctgaagcccgacaacgtgctcatcttcgacagtgcgcgcgcgctcagcgtgaccgcggccggcgcgactttccgcttcgaggagcccgtgcgcgcggcgctgaacgacttcgacttcgcgcgcgtggccaccatcgagaaccgcaagatcgcgggcagcgtccgcgtgccgcagaactggtactacgacttccacttcttcgcgcacacgctgctgcgcgcgtacccgcacatcgccgcggaggacccgggcttccacgcgctgctctcggagctcacggtctcgtgctcgcgcgggacctgcgaccgcttccggctgcgcgtgtcctcgccgcaccccatcgagcacctcgcgcggctggtgcgccgcgacgtcttctcccgctggataaatgccgccgcggacgcccccgacgccgccgcactctcctgagcccacgcccgcggcgccgggctcgctgtacgacgtcttcctcgcgcgcttcctgcgccggctggccgcgcgcgcggcgccggcctcggccgcctgcgccgtgcgcgtgggtgcggtgcgcggccgcctgcggaactgcgagctagtggtgctgaaccgctgccacgcggacgcggccggcgcgctcgcgctagcctccgcggcgctcgccgagacgctggcggagctcccgcgcgcggacaagctcgccgtcgcgctcgagctgggcgtggaccccgagcacccggagctgacgccggaccccgcctgcgcaggcgagagcgcactcgcacagaacatcgacatccagacgctggacctgggcgactgcggagaccccaaaggccgccgactgcgcgtggcgctggtgaacagcggccacgcggccgcgaactgcgcgctcgcgcgcgtggcgaccgcgctgacgcgccgcgtgcccgcgagccggcacggcctcgcggagggcggcacgccgccgtggacgctgctgctggcggtggccgcggtgacggtgctcggcgtggtggcggtttcactgctgcggcgcgcgctgcgggtacgctaccgcttcgcgcggccggccgcgctgcgcgcgtagccgcgcaaaatgtaaattataacgcccaacttttaagggtgaggcgccatgaagttgctcgtcggcatactagtagccgtgtgcttgcaccagtatctgctgaacgcggacagcaacacgaaaggatggtccgaagtgctgaaaggcagcgagtgcaagcctaggccgattgttgttcctgtaagcgagacgcacccagagctgacttctcagcggttcaacccgccgtgtgtcacgttgatgcgatgcggcgggtgctgcaacgacgagagcttggaatgcgtccccacggaagaagtaaacgtgacgatggaactcctgggggcgtcgggctccggtagtaacgggatgcaacgtctgagcttcgtagagcataagaaatgcgattgtagaccacgattcacaaccacgccaccgacgaccacaaggccgcccagaagacgccgctagaactttttatggaccgcagatccaaacgatgatgcgatcaggtcatgcggaagaaggcgccacggagcaaagtgaaaaaggaccgcctagcagtcgagaccctcccgccgcagccgcggacaccccacacccgccttccacccgccagacgccaacaccgcagccaacaagcatgcacccctcgccgcgcaggctgctcggcgcgctcgcgctggtggcgctgggcttcctcctcggcgggctcttccgccccgcggcgccgccgctgccggccgccctcgtggaggcgggccccgtccgcgcgaacggctccgcctcggtgacctgcctgaccgtcggcggcgacgggcggcacatggcggtggtcgcgcacggcggcgggacgctctcgccggtgtacccgctcgccgccggcatgcacgcgaccttcgcctcgctgcgcaagggcgcgctgctgctgaacgtcgcgaccgtgcacatctacgacgtgcgcgcgctcgggccggagttcgagctgacctgcgtcgcggtggcgggcggctacaacgcggcctgggcggccgcgcggcccgcggccgagtggcgccgccagctggcgcggatgcaccgctcggagctgtgaccctctccctcccggtctcccatccgtttttgtaatcggccttagtagattagaccagcatcccgcgcccttgtccgccgcccttcgctcgctcacgagcgaatcagtcaattgattatttttatcgcccgcccgctcactccggtaagggaacgcggttaacccactcacgagaacaagcgaccgccactcacttgaggtaagggaacggttacggtcaactcactcacgagaacaagttgactcactcctcgaggtagagaacgagagaacaagtgaccgtactcactcacgagaacaagttgacgcaccgctcaccgaggaagggaacagagaacaagtaacagtaaccgttacctcactcgccactcctcggaataatagaacgagagaacgagagaacgagttaaccgttgctcactcgctcactcggtgtgagagaacaagtaacgttgctcactcgctcactcggtgtgagagaacaagagaacgagtagctgttgctaactcaatcacccctcggagtaagagaacaagagcagtcaactacccactcagtcttggatgagaggcagaggacgagttgacgagttgaacagttaatcctcactcactcagagcgagagagcgagagagtggaggacgagttaacaagtcaatcctcactcagagtgagagagtgagagagtggaggacgagttaatggttaacagttatcaccactcagagtgagagcggaggacgagtcaaccactcgctcgcccactccgagttagagagggaaccagtgcgagttaacgcgcacacgagcgagagaacgtaaactcgctcgcgcgctcgctcggctaaccgtcggcctctcccaaaactcttcgtaaaactttcccgatgacagttcaccctccaaaactttgtaaaactaaactgttcggaggtcggtctgctgcctctctaactctccgtaaaacgtttgtaaactgtcggaggtcggtgacccgctcaaccgtccgcgaaaacttttcgcaggcagtgtctgcctctctcggactctccgcaaacactttcgcggaacctcggagggtggtcgacctctctccaaactcttgcaaaactttttcgcggaaccgttggaggccagtcctccctccaaactctttgtaaaatcttttcgaggccagtcctcctctccaaaacgttccgcaaaatctttgggaggtcggcctctcctctccagaacgttccgtaaaactcttggaggccgcccgcggcacgcgaggcggaggatccggagggtgtcgacctccctcaaaaactttgtaaaaactttttataaaactttccgcggaacctcggagagtaggtcgacctctctcaaaactcttataaaacttttccgcggaaccgttggaaggtaggtcgacctctctcaaaactcttataaaacttttccgcggaaccgttggaggcaggtcggcctctcaaactctttgcgagaactcttcgcgagaactcttcgataactttaggaggtcaggtcgacctcccaaaacttttgcgagaactctctgtaaaactttaggaggtcggtacctccctcaaaactttttataaaacttttcgcggaacctccggagacgggccgccgcccgcgaccgcgggagcggagaggccgacctcccgagacgttccgcgttaccgtcggggtaggcgtcctctcgagaacgccaaaagacttcgtgcaaaaacttttcggaggggcgcggagggcgggtcagctcccgcgaactcccgcagaaccttttcgcgcgaccgcgaaggccggccgcctctcccacactctcaagagcttttcggaggagaggaagggcaggtcgcccccacctccgacgctttgtaaaaacgtttacgcggaacctcggaggcaggtcgcctccctcgaaaactcctcgcgaaacctttaaaaactttttgcgaaaacttttcggaggatgtcggagggcgggcggctcttccaaacctccgcagaaccttttcgcgcaaccgttggaagacaggtcggcctctctcgaaaacttttaaaactttgtaaacgcgttggcgggaccgtcgcgggagagcggccgcccgcggcacgcgagaggaggaaccgttggaaggcagtcggcctctcccgaaaactttttataaaaacttttccgcggaaccgttggaggcaggtcggcctctctcagagtctaaaaactttttgcgggactcggacggcgcggtcacccgaccacctgactcctgtctacccgactacttgacttctgtttccctgactcccgactccctgactcccgactccctgactcccgactccctgactcccgactccctgactcccgactccctgactcccgactccctgactcccgactccctgactcccgactccctgactcccgactccctgactcccgactccctgactcccgactccctgactcccgactccctgactcccgactccctgactcccgactccctgactcccgactccctgactcccgactccctgactcccgactccctgactccctgactccagagcgaggtctcgcggctgcggggtgccgcctccgcggagtcgcgttcccgcggacgcccgtcctcgaaagcattcagcagttccagcctctgccgtagctcctcccgcaggaactcctggtccgcgttctcgcggcagcgcggctcagccgccgcgggagccggccgccgccccggcgaagccgcggatccgctgttccggcgaaggcaggacagacattttttccagcccataaattaaaaagaacaagaaattacatgtgaaaaaatttgaggttgatttattgacgaaacgttcaactaaatacaatcctaaaagtttttatcatcatgataattttctgttgattctttttaatttatgggctggaaaaaatgtctgtcctgccttcgccggaacagcggatccgcggcttcgccgg

SEQ ID NO: 3 - DNA, 188455 bp, Artificial Sequence
  Synthetic Poylnucleotide
ggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagaaagagatagttagtctagatatttttcttagtacaaaagtcaatgttttaaaatatatggacaagaatttgtctgtataaaaacttgtgtgaaattttgtaccaaagaaaaaatgtgagcagtatccctacatggattttactagatcatttatatacaaaaaatattatacgatctacgttttattatatgattttaacgtgtaaattataaacattattttatgatatacaattgtctggtaacctagatgggcataggggatgttgataagctcgacgagtatatgttgttggacgttattgtttaagaaatagttgatgcatcagaaagagaataaaaaatattttagtgaaaccatcgaagagagaaagagataaaacttttttacgactccatcagaaagaggtttaatatttttgtgagaccatcgaagagagaaagagaataaaaatattttatgactccattgaagagagaaagagaaaatgagaatgagaataaaaatattttagtgacaccatcagaaagaggtttaatatttttgtgagaccatcgaagagagaaagagaataaaaatattttatgactccattgaagagagaaagagaaaatgagaatgagaataaaaatattttagtgacaccatcagaaagaggtttaatattttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgataccctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacacattttgtatcgacgatcgttgaaccgatgatatcttcgtaactcactttcttatgagagatgttagacccgagtactggatgggtcttgatgtcgctgtctttctcttcttcgctacatctgatgtcgatagacacctcacagtctttgatcatagcaagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggatgaggatgattgctgaagactggcaggcatagcagctgccgccaggcacatgcatgccagtacgatatattgtttcataattgctattgattgagtactgttctttatgattctacttccttaccgtgcaataaattagaatatattttctacttttacgagaaattaattattgtatttattatttatgggtgaaaaacttactataaaaagtgggtgggtttggaattagtgatcagtttatgtatatcgcaactaccgggcatatggctatcgacatcgagaacattaccacatgataagagattgtatcagtttcgtagtcttgagtattggtattactatatagtatatagatgtcgcccactagagttactgtctccgaatgcggcatgatagtatcattctttgctttcgttaactgtttggaggaagaatctttgttattgcatttaatctcgaaattcagagtgcacacctttctcctgtaaagaaacctgaagtcgctaccttattaagaacggagaagtatccatcacgaaagacgggatcgcagtctttatgattcatagtaatagttagttccgacgttgagatggattcgctgagaccggtagtggtcgtccgagtacacgacgtgtcgttgacgggatacagattaatttccacatcgatatagttaaaggtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtcgtgttacacgatcgcgtcttccgttacaacttagacaagcgggtaaatgattattgcgagatgtgaaggtacccgaaccacacggcgtacatcgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcatgatttaataatgtagtaatcgtcgtcttgttcctgtttcctacttctccaatcatatagatattttctttctatcatggataatatttgtaatggttctttccgtacaacatactgtttagatgatattgcgcataatttccggaggcaaatacgatagtctagattgaccgatggtagactctaatttattgagtgctttgtcgacgagtttacttttacgctccatcgatagatggcactgttctatgagatcgtcgtacatgggaaatgaaatgtgtctgtctgaatgtatggctttaagatagctgtgataccgtatacaggtcggtgtcggagattcgaatctctttaaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttaatcataggtagagatactttcagtctgtggtggatgatgtcattcacaacatccgccttgtatatgatgtttctgttttcaaacaccaagtcgaataccgtctttagtcggaaggttgatgtcgtatccgatgtatgaggcaacattgttgttacaattttgaaaggcggtattatagtattcgtctttctgaatgtcgaacctatctaatagataccgtagtatattgagagtgtatccttgattatgttttatgaatagataaagtagatgttgtccttcttccttttgttcgtgccaattgagtaacattatgagaatatgacctgttgcacaatcgttccatgatgggtgtacaatcaagattattacgtatcctcgagataaaagagcatacaccacacgaggactatgtttggtatactgttgaaggtaagtgtgtaaccgcgttaatgtttgctccataatctattatcgcgtagatgaatcgcttctcggctcgcatcttagtgtgacttgacttgtaataattgctttcgtagaacgtggatatgtgtttacagtagtaatgaagagaagtgagttcatcctcgtcggcgcaattagggtcggatcctttgtacagaacgtaatagtttaagctcccattgaatttatatctaagataacacagcaatagatcggatgatttactaaagtcatcaatggtgtccgttagtatatcaaagatcttgttatcgattgatagtggtcatccttgctatcaaagttacgcatgccgtggtgtaacaatatctttaatacagatggattaaatcgtgtattcatcgtatagcaatgtaatggagagttacctcgtttattcagatcgcagtgtttaataactagcttaaacagatgagacgatgtatccacatcaaagaacgtaaaatacatatgacagacattgttgacagaaacgtgaccttcattcttaccgtcgtccataaatacgttaggtataaaccacatactatcgcgaacgatgctcacaatctcgtccatctcataatgatttactttttcataattaaagatgtgaaagaaaaacagaacaatatatttttttagtaatgtttatgcgagacatataaaataaactccgtgtttatgatgccggtaaatgtttttatcatcttggacggaatcgattttgtaatatgtcatggaaacaaatgaaacaggacattatcgctccatgataaattatttaatggagtaataaagtatctccatgggtaatttcgaaatcaagttatcgtctgtattaatgttgtccactatggagtcgatcctctcattgttctttacagtttctgtaatgatggacgttagttcttttttgtaccatttgatgtcggattctttgcgtatctcagtctgtggcgtttgcttcgtttaaagaatatatcaaacatggagacgcctgatatgtagacattcttcattctattaatgtctgctctatagcgctttagttccttatgacgaccggagatatcatactttactttagaaggaaaatcatcatctaggattaaggcgtatctgatacaggcgaataatggttcaggatatagatagcgtatatctctattaaatgcgtcaatcatagtctctagagtgggatggtaactcagtaataaatcaactatcctcgttttgttttctcttctgtaactgcttttctggatggccgtattgattatcgagcgtttactttagaaggaaaatcatcatctaggattaaggcgtatctgatacaggcgaataatggttcaggatatagatagcgtatatctctattaaatgcgtcaatcatagtctctagagtgggatggtaactcagtaataaatcaactatcctcgttttgttttctcttctgtaactgcttttctggatggccgtattgattatcgagcgtgatgttgtaacactcgctccatattccaataaccgctttgcaaattgtatattattgacatcgaccgcgtaatatagtagagttatcgatcatatctatatcatccatgtacttgcttagtatatcaaatacatctatcagtatggtttcataacagtgatacccgcaattattaaatctcgataatatcagaccgtacatacatagacggccattgttcgatacgtgatttacagccgcgtgtccatattttccacgataaaccttacgacgtttacatcgacgagattattattaacaaagtagtcgtgcagaggatagttgttgtccgttatctaacatgcatcgaacgaccatatcgccgtaatgtaagtagtttatcaacatggcttgtacatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataataatttaacaatctctatatctatggttgagcaagaccagtagtattggatgggtaaagatcctccttcgtctctgccatggatggaaacattgttatcgatcaaacatttaattacatccttggatagagattgagattctctatgagacgatatatagtaatgaagagagttcttacacatatcactgtcgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatacgaatacagatcgaaatcatttatattcgacttgagttcgttagaggaattcgaatagctggatatcagtagatgcacaatctgagatttgacgtatctatgcttactgtatactcctagcggagttaatccttcgttgtttctacaaagtctctcgactccgcgagagagtaacagccgaacaatcttaatgtctgtatcgcatttattgaagacgtaacaatgtagcgcattgtttcctcgtctatctatatgttttgataagttgtgacacgtttcaatctctggttttatttttttgtacgtcacatcttcatccagtagacgacatagaatagtgcactctctaccacaataatccatagctattctggtgctaattattcctatttcacgaaggcaatcattcctcataagatgataaaaagtgtagtgagagagcatgaaggagatttagtatttagcagtgcggatatgatccaagagggtgagatagtcgttctcgttcagaatctttcgcagcataagtagtatgtcgatatacttatcgttgaagactcttccagagacgatagctgattgagtacaaagtccaatgattgcacgaagttcttcggcggttttcatggagtcatttctgatgaaacatttaatgatctccacgcaattgtcccacggaagtgaatccttcaactcaccaccaaagagctccgttgcatcagttctgaaagagatgagaagcctgtagagagaccctgcgctttctctatgggtccatctatgagaaacccacaggatgtattcagtcagacaatgtctgacgtcggccacggtattcagggagtccttagtagcgtggcaatgacagggactgaacttggcacaaggaaaggccattgtgaaggtagacctgtagccgtttatgctaatagagggctttaatttccattttttaatgggttgtggatgaggaatgagagtgatatcatattgagatacgtagttatgtagaggtgtatttcctatattatttactttcggtttcatattttaccaactctttaataaatttcttttcacgatgcatcttattaaatgacgttttctcataagtggacatatagatgcagaagtaatgaagaaaagtattacctctatcatctacataattagggtctgctcctttttttaacaacttatacagtacgtagtagtagtttatcggttttaaatcaagtctagaatatatagtggattaatatatttttatattagctaaagctatctatactatcagaaagcatatcattctcaacttcatcatgagttaaatatttgtgtaatggatgtcatgaacattaaacgtattcatgacatactcctttaataggttttttaaaacagatgattcaaatccttcattcattagataacagtgtaacggagtcgtaccttctactagtttgtttatatcacagcattctacaaacagtctaaacaatagagaagacggacagactttaacgtataaatgacacatgttatcgatattcgttgatgaattattattaaacgtagttatgataaatgattctaacgacatctctcgctagagataaaatctagtatcgtatcatactcgcatagcatagtttttcataattaatacaatatttaaaagacttattcagaaagtattttaatacatgtatcatcgatggagatccatatgaggagtcacttgtagttcttcagtagtaataacagtgctatcatcgatagtataattatatgttgttgtaattggagtaactgttggtagttcttccgtggaatcaataattatactaacagcaatagtataattatataaatatgttccgttgatatcacatattttaatgaactcatttctaacaccctcagctatatctgtccaattaaatgtagccaacaatctactacgttctctttgattgactacttgtacggtagcgacgctacactatctttattgtcttctacatgctccaattgaatgtcatgatacaacgcagtttttcttatgcatgtttcataacaccacgaacatgtcgcagtaagataatttctgtaaattcatgattgccggtcataaacaagcccgtcaataattgtggctatatattcagtttatagagcaaaataattaagcacaatagcgcttaatctcaaaatatgttatgtttatttttttcatattaaacatactggttaaaatcctctaaaggctgatcttcatctataaatcaagatcataattacatttagacagtggtttcatgtttataaaaatgttctttttgtgtgaataaggaatatactaatcaataatcaaccatcgaccccattacgatagtatgcaggcaaccccccattagagaggtacgtgtaatcagtctctccagttttagtatttttataagtcattgttacataaacggcttttaaacagtctcctcgataataagccatatctggaaatttattaaatactcgagtcattttacgcacggtcaaaaaagtaagtaatgtcgacgacttcttacattctatagaaacacctagaatactcattttcttttggaaaatatcctcagactctgatttgaacaatgcacgacctatagtaaaccgtgaccaataagttatattagtcaatggtatatccaaaccatcaggtgtggatagtacgccgatagtccagtctttggtatcgatagtgtagttattgaactgagaagttaccgtatagtctttttggtcatctctaaacaaggaaactaatacctctacactattgaacgatttatcttccgtaatgggtggaataacgggaatataaagtggactagcgatggatgaagtcacgaatataagacacgctattaatccgtatatcatcattttgatattacttataataacgatttgtttaatttttagtttatactattaattgtaaatgatattattattttttttaagtattatcagctttagtttatactattactatttgtaatatttagacatagataaacgtgataaaagtctatttgtttatatttattgcggatagcagtatttccctataaaaagtatacgtcctgtgttgtctttaatcatgtacatgaatggatggtttatgtagaccttcgtacgatataccatcgaaaagttagtcataaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctaaaatcggtaccagattatacggttctgtcatttccactttaaactttggcatatacaagtctatacttttagtagataacataccacaccattttttaaatttttcatctgttatatttttttctatgttatatataccttctatgtcgtccggtagtataattaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcatcgtcttaacccattcgttgattagttcctttgtttggttagcattattaaagtttacagtttgaaaatcgtcttttattttttgtaggaaggaggcgtggaactcgatactatcgctaccgtatattttatttgcggtagctagtgtcgcacaatacggaatatctacgtccatgtcattattgtcatccttcttatcatcgggtgtattctcattcatattctctatatattttgatagttgttcagctgtagaaccagctgctccatgatttagaatagataaagtagataaaatagaaactggagaaatcaaaacattttcatcagggtgttttaagattagttctttaaagatatccatggtatagaccaaacaataacgataacgatatatatcataaataaataatgttaaatttcagtttatgtttgtaccccgtattcatacttaacaaattggtattgcgtacacaatcaatcatattacataccattaataatgcaagcataaaaaatcgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacaaaatccatcaaaaatgttgataaattatctgatgttgttgttcgctgctatgataatcagatcattcgccgatagtggtaacgctatcgaaacgacatcgccagaaattacaaacgctacaacagatattccagctatcagattatgcggtccagagggagatggatattgtttacacggtgactgtatccacgctagagatatcgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattattattacgtgttgtctattatctgtttataggttcactcgacgaactaaactacttatacaagatatggttgtgccataatttttataaattttttttatgagtatttttacaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcaaatacagtatccgattgagattttgcatacaatactagtctagaaagaaatttgtaatcatcttctgtgacgggagtccatatatctgtatcatcgtctagtttatcagtgtcccatgctatatttctgttatcatcattagttaatgaaaataactctcgcgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttctttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccggtcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatccacatttggctaatcaatttcgggcttggaaaaaacgtatcgccggaagggactatataactaacttatctagagatacaggaatacaacaatcaaaacttactgaaactatacgtaactgtcaaaaaaatagaaacatatatggtctatatatacactacaatttagttattaatgtggttattgattggataaccgatgtgattatcaatcaatattaagagggttggtaaattggtacatagctaataatacctatactccaaatacacccaataatacaacaaccatttctgagttggatatcatcaaaatactggataaatacgaggacgtgtatagagtaagtaaagaaaaagaatgtggaatttgctatgaagttgtttactcaaaacgatagatactttggtttattggattcgtgtaatcatatattttgcataacatgtatcaatatatggcatagaacacgaagagaaaccggtgcgtcggataattgtcctatatgccgtacccgttttagaaacataacaatgagcaagttttataagctagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacgcactacttcagccaaatattcttttttgaaacgccatctatcgtagtgaggacacaagtgaacctataattatcaaatttattagtatcagtcacatgaaggactttctgtagagtgacgattccactatctgtggtacgaacggtttcatcttctttgatgccatcacccagatgttctataaacttggtatcctcgtccgatttcatatcctttgccaaccaatacatatagctaaactcaggcatatgttccacacatcctgaacaatgaaattctccagaagatgttacaatgtctagatttggacatttggtttcaaccgcgttaacatatgagtgaacacacccatacatgaaagcgatgagaaataggattctcatcttgccaaaatatcactagaaaaaatttatttatcaattttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctgaaatcttagacgatgtacagtcatctataatcatggcatatttaatacattgttttatagcatagtagttatctacgatgttagatatttttctcaataaatcaatcacataatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagaccctttttgtatgtataagtgtaaaaattataacatccatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagttccatattccactagagggatatcgccgaatgtcatatactcaattagtatatgttggaggacatccgagttcattgttttcaatatcaaagagatggtttccttatcatttctccatagtggtacaatactacacattattccgtgcggctttccattctccaaaaacaatttgaccaaatctacatctttattgtatctataatcactatttagataatcagccataattactcgagtgcaacatgttagatcgtctatatatgaataagccgtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactttgaatacagatgagagatgatatacagatgcaatacggtaccgcaatttcgtagttgataatcatcatacgcgtatcagtactcgtcctcataaagaacactgcagccattttttatgaacaaatcaataattttaggaacaggatcattgtcattacataattttctataactgaacgatggttttcacatttaacactcaagtcaaatccatgttctaccaacacctttatcaagtcaacgtctacatttttggatttcatatagctgaatatattaaagtcatttatgttgctaaatccagtggcttctagtagagccatcgctatatcctttaactttaacatgtctactatttgtgtattcttctaatggggtaagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctttcaacatctgtttaagttcatcaagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaaccccactttttacaccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttgactaaagtttctagtcacaagagcaatactaccaacctacactattatatgattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgacttaatacaatgataaagtatactacatccatgtttatctattttgtttatatcattaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacgtaaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatatcgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcatttttttggtttctttcatttcagttatgtatggatttagcacgtttgggaagcatgagctcatatgatttcagtactgtagtgtcagtactattagtttcgatcagatcaatgtctaaatctatagaatcaaaacacgataggtcagaagataatgaatatctgtacgcttcttgttgtactgtaacttctggttttgttagatggttgcatcgtgctttaacatcaatggtacaaattttatcctcgctttgtgtatcatattcgtccctactataaaattgtatattcagattatcatgagatgtgtatacgctaacggtatcaataaacggagcacaccatttagtcataaccgtaatccaaaaatttttaaagtatatcttaacgaaagaagttgtgtcattgtctacagtgtatggtattagatcctcataagtgtatatatctagagtaatgtttaatttatcaaatggttgataatatggatcgtcgtggcaatttcctaagacgaaaataagacataaacacgcaataaatctaatcgaagacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaatttcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataacacacatgtcttaaagtttattaattaattacatgttgttttatatatcgctacgaatttaaacagagaaatcagtttaggaaaaaaaattatctatctacatcatcacgtctctgtattctacgatagagtgctactttaagatgagacatatccgtgtcatcaaaaatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggtaaagctattgtagatgtgatttttcctaaatctaatataaaactcgtttactagcaaacactttcctgatttatcgaccaagacacatatggtttctaaatctatcaagtggtggggatccatagttatgacgcagtaacatagattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacaccagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaaatgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaagcccatatatgttcgctattgtagaaattgtttttcacagttgctcaaaaacgatggcagtgacttatgagttacgttacactttggagtctcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtataattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttttcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgtttcaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgttttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtggaattaatattatgaatcatagtttttacacatagatctactacaggcggaacatcaattattatggcagcaactagtatcatttctacattgtttatggtgatgtttatcttcttccagcgtatatagtctaatagcgattcaaacgcgtgatagtttataccattcaatataatcgcttcatcctttagatggtgatcctgaattcgtttaaaaaaattatacggagatgccgtaataatttccttattcacttgtataatttccccattgatagaaaatatcacgctttccattcttgaagtactataagtaattatagtataatgtaaaggtttatatattcaatattttttataaaaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgtccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatcctcagtcatcttgtctagaatggcaaatctaactgcgggtttaggctttagtttagtttttatatctacatctatgtctttatctaacaccaaaaatataatagctaatattttattacaatcatccggatattcttctacgatctcactaactaatgtttctttggttatactagtatagtcactatcggacaaataaagaaaatcagatgatcgatgaataatacatttaaattcatcatctgtaagatttttgagatgtcttattaaaatattattagggtcagtactcattatcattaggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgcttagtaatttaactattttagttaacaactattttttatgttaaatcaattagtacaccgctatgtttaatacttattcatattttagtttttaggattgagaatcaatacaaaaaattaatgcatcattaattttagaaatacttagtttccacgtagttaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttattcttttaaacagatcaatggtgtgatgttgattaggtcttttacgaatttgatatagaatagcgttcacatatcctccataatggtcaatcgccatttgttcgtatgtcataaattctttaattatatgacactgtgtattatttagttcatccttgttcatcattaggaatctatccaaaatggcaattatactagaactataggtgcgttgtatacacatattgatgtgtctgtttatacaatccatgatatttggatccatgctactaccttcgggtaaaattgtagcatcatataccatttctagtactttaggttcattattatccattgcagaggacgtcatgatcgaatcctaaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacaaagtctacactaaaatgattgaacaatagatagtctaccattgtttcgtattcagatagtacagcgtagtacatagcatcttcacaaattatatcattgtctaatagatatttgacgcatcttatggatcccacttcaacagccatcttaaaatcggtagaatcatattgctttcctttatcattaataatttctaaaacatcatctctatcataaaagatacaaatattaactgtttgatccgtaataacattgctagtcgatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttattatgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagttcttttatgtcaagaaggcactggtttagttcatctataaatgtcacgccataactaccacgcatgctatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctaccgaatacccgagagatgcgatacaaaagagtaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtttgagttccttgtttttgctaattatttcatccaatttattattcttgacgatatcgagatcttttgtataggagtcagacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcagtgtttcccttgtcatcaaattgtgaatcatccagtccactgaatagcaaaatctttactattttagtatcttccaatgtggctgcctgatgtaatggaaattcattctctagaagatttttcaatgctccagcgttcaacaacgtacatactagacgcacgttattatcagctattgcataatacaaggcactatgaccgttgatatccgccttaaatgcatctttgctagagagaaagcttttcagctgcttagacttccaagtattaattcgtgacagatccatgtctgaaacgagacgctaattagtgtatattttttcattttttataattttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgaaacgaccaatagtctaattttgcagccgtaatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacaacggtttaatacacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggcgagaagacaatattatcatcttgaatatttttatacgctactataccggcattggtaaatccttgcagacgataggtagacgctgaacacgctaacgatagtatcaataacgcaatcatgattttatggtattaataattaaccttatttttatgttcggtataaaaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttatatctattttattcaagagaatattcaggaatttctttttccggttgtatctcatcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggcgcagaagcaataaatacagagtgtggaacaccacttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattccttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtctctgtaatcactgcgattgtattatccggattcattttatttgttaaaaaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcggggggtgttaatcttggaaattatttttctaaccttgttggtagccttcaagacctgactagcaaatccagccttaattttttcatgattgactaatgggtcgtattggtatttataaactttatccatatctctagatactgattctggacatagctttccgactggcgcatttggtgtgatggttcccataagtttggcagctagcagattcagttttgaaacagcatctgcattaactagaggagacattagaatcattgctgtaaacaagtttggattatcgtaagaggctagctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatttgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttataaatgaaattgtcgccaatcttacacccaaccccttgttatccattagtatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccattatctatatcatctacataatctacgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcagaacttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgcctcatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatacgagtaaataactatagaagttaaactgtgaatgtcaaggtctagacaaacccttgtaactggatctttatttttcgtgtatttttgacgtaaatgtgtgcgaaagtaaggagataactttttcaatatcgtagaattgactattatattgccacctatagcatcaataattgttttgaatttcttagtcatagacaatgctaatatattcttacagtacacagtattgacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatagatctaacggtttcttcactcggtggatacaataaatgtttaaacatcaaacatgcgaaatcgcagtgcagaccctcgtctctactaattagttcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaataacaataaattttttttcagttatctatatgcctgtacttggatcttttgtacatcgatatcgccgcaatcactacaataattacaagtattattgatagcattgttattagtactatcataattaaattatcgacattcatgggtgctgaataatcgttattatcatcattatcattttgtaattgtgacatcatactagataaatcgtttgcgagattgttgtgggaagcgggcatggaggatgcattatcattattatttaacgccttccatttggattcacaaatgttacgcacattcaacattttatggaaactataattttgtgaaaacagataacaagaaaactcgtcatcgttcaaatttttaacgatagtaaaccgattaaacgtcgagctaatttctaacgctagcgactctgttggatatgggtttccaaatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgtcagtgtgggtacaaatatgtacattatcgtctacgtcgtattcgatacatccgcatacagccaacaaatataaaatgacaaatactctaacgacgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatatgattagtaatgaccattaaaataaaaaatattcttcataaccggcaagaaagtgaaaagttcacattgaaactatgtcagtagtatacatcatgaaatgatgatatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtggtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcttcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgttcaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcaacagggtagttcgtagattttaatgtataacagagccatctgtaaaaagataaactttatgtattgtaccaaagatttaaatcctaatttgatagctagctcggtatctactttatctgccgaatacagtgctaggggaaaaattataatgtttcctctttcatattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgagagttcctgaccatccatagtttgtatcaataatagcaacatatgaagaacccgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaacaattaactattttgtctctgtttttaacacctccacagtttttaatttctttggtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactgtgaccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcgatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaaccgtttttaagttctggaatattatcatcccattgtaaagcccctaattcgactatcgaatatcctgctctgatagcagtttcaatatcgacggacgtcaatactgtaataaaggtggtagtattgtcatcatcgtgataaactactggaatatggtcgttagtaggtacagtaactttacacaacgcgatatataactttccttttgtaccatttttaacgtagttgggacgtcctgcagggtattgttttgaagaaatgatatcgagaacagatttgatacgatatttgttggattcctgattattcactataatataatctagacagatagatgattcgataaatagagaaggtatatcgttggtaggataatacatccccattccagtattctcggatactctattgatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacagttattgggccagtatactgttagcaacggtatatcgaatagattactcatgtaacctactagaatgatagttcgtgtactagtcataatatctttaatccaatctaagaaatttaaaattagattttttacactgttaaagttaacaaaggtattacccggatacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagggaacttacgatacatctgtttcctgtaatcgttaaattttacaaatctataacatgctaaaccttttgacgacagccattcattaatttctgatatggaatctgtattctcaataccgtatcgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctataacgtctctattttctattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcaactatcaacaattttgtattattctgaatagtgaaaaccttcacagatagatcattttgaacacacaacgcatctagacttttggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgtcaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtatcaatatagcaacagtagttcttgctcctccttgattctagcatcctcttcattattttcttctacgtacataaacatgtccaatacgttagacaacacaccgacgatggcggccgccacagacacgaatatgactaaaccgatgaccatttaaaaacccctctctagctttcacttaaactgtatcgatcattcttttagcacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaacccacgtaacattggaattaattatcgatagtaatgcatcgacgcttccaaaattgtctattataaactcaccgataatttttttattacatgttttcatattcattaggattatcaaatctttaatcttattacgattgtatgcgttgatattacaagacgtcattctaaaagacggaggatttccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgttttttctatgctataaatgaattctcattttgcatctgctcatactccgttttatatcaataccaaagaaggaagatatctggttctaaaagccgttaaagtatgcgatgttagaactgtagaatgcgaaggaagtaaagcttcctgcgtactcaaagtagataaaccctcatcgcccgcgtgtgagagaagaccttcgtccccgtccagatgcgagagaatgaataaccctggaaaacaagttccgtttatgaggacggacatgctacaaaatatgttcgcggctaatcgcgataatgtagcttctagacttttgtcctaaaatactattatatccttttcgatattaataaatccgtgtcgcccgggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtgacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtatcaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtttccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaatttgattcttcgttcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtatttcgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatataatttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacctgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacaaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatcggccttatcgaatactcttccgtcgatatctacacaggcataaaatgtaggagagttactaggcccaactgattcaatacgaaaagaccaatctctcttagttatttggcagtactcattaataatggtgacagggttagcatctttccaatcaataatttttttagccggaataacatcatcaaaagacttatgatcctctctcattgatttttcgcgggatacatcatctattatgacgtcagccatagcatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatggttttaatagcctcacacacaatctctgcgttagaacgttcgtcgatatagattttagacatttttagagagaactaacgcaaccagcaataaaactgaacctactttatcatttttttattcatcatcctctggtggttcgtcgtttctatcaaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagctgctctagtttgaatcatcatcggtgtagtattcctacttttacagttaggacacggtgtattgtatttctcgtcaagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattatgactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggaaaataattggaacacaagttgataaaatgttgatagctgaatctgataaatatacaatagatgcaaggtataacctaaaacccatgtatagaatcaagggagaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaagatatatacactctatttcaacaaactggtagaatcgtccatagcaatctaacagaaacgtttagagattatatctttcccggagataagactagctattgggtgtggttaaacgaaagtatagctaatgatgcggatatcgttcttaatagacccgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattctttcatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacctagatgctagtgactattatcccatttcgttgggattacttaaaaagttcgagtttctcatgtctctatataaaggtcctattccagtatacgaagaaaaagtaaatactgaattcatagccaatggatcgttctccggtagatacgtatcatatcttcgaaagttttctgctcttccaacaaacgagtttattagttttttgttattgacctccatccctatctataatatcttgttctggtttaaaaatactcagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataagtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtacattagccggacaaatatatgcaaaataatatcgttctccaagttctatagtttctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggtcttgtatgtcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatcgacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcataaatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaagagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctttatttaatactttacccatgcaactgaacgcgttcttggatatagaatccaatttgtacgaatccaatttttcaaatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcgccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaataacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattttcgttaaacagcatttctgtcaacggaccccaacatcgttgaccaattaagttttgattgatttttccgtgtaaggcgtatctagtcagatcgtatagcctatccaataatccatcgtctgtgtgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgtcagatctattttaaagttaatcatataggcattgatttttaaaaggtatgtagccttgactacattctcattaattaaccattccaagtcactgtgtgtaagaagattatattctatcataagcttgactacatttggtcccgataccattaaagaattcttatgatataaggaaacagcttttaggtactcatctactctacaagaattttggagagccttaacgatatcagtgacgtttattatttcaggaggaaaaaacctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattattttctcaacaagttctcaataccccaatagatgatagaatatcacccaatgcgtccatgttgtctatttccaacaggtcgctatatccaccaatagaagtttttccaaaaaagattctaggaacagttctaccaccagtaatttgttcaaaatagtcccgcaattcattttcgggtttaaattctttaatatcgacaatttcatacgctcctcttttgaaactaaacttatttagaatatccagtgcatttctacaaaaaggacatgtaaacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggtattaagaattcgtttttcgacatccgtcaaaaccaattcctttttgcctgtatcatccagttttccatcctttgtaaagaaattattttctactagactattaataagactgataaggattcctccataattgcacaatccaaactttttcacaaaactagactttacgagatctacaggaatgcgtacttcaggttttttagcttgtgattttttcttttgcggacattttctagtaaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtggtagttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagcgcgaatgtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaattatcgttcctggtatatagataaagagtcctatatatttgaaaatcgttacggctcgattaaactttaatgattgcatagtgaatatatcattaggatttaactccttgactatcagggcggcaccagaaattaccatcaaaagcattaatacagttatgccgatcgcagttagaacggttatagcatccaccatttatatctaaaaattagatcaaagaatatgtgacaaagtcctagttgtatactgagaattgacgaaacaatgtttcttacatatttttttcttattagtaactgacttaatagtaggaactggaaagctagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcttttatttccacattagatggtaaatccaatagtgaaactatctttttaggaatgtatggactcgcgtttagaggagtgaacgtcttaggcgtcggaaaggatgattcatcaaacgaataaacaatttcacaaatggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatctggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaatggagtaaaataaatatcattaatatatgctctagatattagtatttttatcaatcctttgattatcatcttctcgtaggcgaatgattccatgatcaagagtgatttaagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtttactattctatttaattttgtagttaatttatcacatatcacattaattgactttttggtccatttttccatacgtttatattcttttaatcctgcgttatccgtttccgttatatccagggatagatcttgcaagttaaatagaatgctcttaaataatgtcatttttttatccgctaaaaatttaaagaatgtataaacttttttcaaagatttaaaacttttaggtggagttctagtacacaatatcataaacaaactaataaacatcccgcattcagattccaacagctgattaacttccacattaatacagcctattttcgctccaaatgtacattcgaaaaatctgaataaaacatcgatgtcacaatttgtattatccaatacagaatgtctgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaagaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccagcggttgtagatttatcatatttctccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggcggtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacacaatgttacacacatttatgatatgggtagagtttttgtccccgctccttttggaggatcgcaagaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttctacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcatttgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttatgatgacttgataacttactttccagataggaaataccataaatatatttctaaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagagaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaaccggtggccaaactccataatttgctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcaaagtttcctattagggttccgcgctttacgtcacccagcatacttgaatcaccatcctttaaaaaaaatgataagatatcaacatggagtatatcatactcggattttaattcttctactgcatcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgctagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctactgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatgttcctccttgtcaatgcactgttcaagaatttatattttccgcattagatgaaaaatggaacaattttaaatcatcttatttagagaccgttccgttaccctgccaattaatgtatgcattagaaccacgcaaggagattgatgtttcagaagttaaaactttatcatcttatatagatttcgaaaatactaaatcagatatcgatgttataaaatctatatcttcgatcttcggatattctaacgaaaactgtaacactatagtgttcggcatctataaggataatttactactgagtataaatagttcattttactttaacgatagtctgttaataaccaatactaaaagtgataatataataaatataggttactagattaaaaatggtgttccaactcgtgtgctctacgtgcggcaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcatgatagaatgtattgttttaaattggtagctgaatgttataaaaatgccggtattgatacatcgtctaaacgaatattaggtaaagatatttttctgagccaaaacttcacagatgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcactgattcctttttcgatgccggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtatctataaatgtagactcgacggatgagttaatgtatatttttgccgccttgggcggatctgtaaacatttgggccattatacctctcagtgcatcagtgttctaccgcggagccgaaaacattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatttagaatggttgttgggctttatcaagtgtattagtcagcatcagcatttggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattctaggaatgttgttttcggatagagttcaatcctttaagatcaacatctttatgacgtttttagattaatactttcaatgagataaatatgggtggcagagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaaaaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtgatagaactgtagagggtcaacaatcgttaataaatctgtataataagatgcaaacattatgtagtaaagatgctagtgtaccaatatgtgaatcatttttgcatcatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaatactagcgtgaacaacttacagatggataaaacttcctcattaagattgtcatgtggattaagcaatagtgatagattttctactgttcccgtcaatagagcaaaagtagttcaacataatattaaacattcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtaccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggcgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccggttgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatttcacaactttactgtttttaaactgttcaaaatatagcatcgatccatgagaaatacgtttagccgcctttaatagaggaaatcccaccgcctttctggatctcaccaacgacgatagttctgaccagcaacttatttcttcatcatccacctgttttaacatataataggcaggagatagatatccgtcattgcaatattccttttcgtaggcacacaatctaatattgataaaatctccattctcttctctgcatttattatcttgtttcggtggctgattaggctgtagtcttggtttaggctttggtatatcgttgttgaatctattttggtcattaaatctttcatttcttcctggtatatttttatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgagaatatcacaggggcaatgtttaccacaatgtataatataagaaacaatttgggtctaggagatgataaactaactattgaagccattgaaaactatttcttggatcctaacaatgaggttatgcctcttatcattaataatacggatatgactgccgtcattcctaaaaaaagtggtaggagaaagaataagaacatggttattttccgtcaaggatcatcacctatcttgtgtattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccatgagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcattgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctattagatacatagatcctcgtcgcgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagaaataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactaccgtatcaaggacagttaaaactattactaggagaattattttttcttagtaagttacagcgacacggtatattagatggtgccaccgtagtgtatataggatcggctcctggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtaagatccaaacgaggaggaaatgaacctagtacggcggatttactaagtaattacgctctacaaaatgtcatgattagtattttaaaccccgtggcatctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtgctactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatattatcttatatctcgtttagaaaaatgctaatattaaaatagctaacgctagtaatccaatcggaagccatttgatatctataatagggtatctaatttcctgattcagatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaaaacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagcgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgctgattattagaccggctattagtttttggatagatagtatacccaaagagaccaatgaattaacttacttattaggtatgatcgttaagaattgtaacttgaatgctgatgaacaggttatccagaaggcggtaatagaatacgatgatattaaaattatttctaataacactaccagtatcaatttatcatatattacatccggcaaaaataatatgattagaagttatatcgtcgcccgacgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttatcaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggagatgaagaatggatgatattggagcaaaatcctaaagccgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcctacagaactaatgtatattctaggtacgtatggacaacaaaggattgatggtgaaccagcagagactcgagtattgggtagagtcttaccttactatcttccagactctaaggatccagaaggaagaggttacattcttaattctttaacaaaaggattaacgggttctcaatattacttttcgatgctggttgccagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccagacatcactcttcgaaaagaaacagataaatatgtagtagatataatagttaatagattatacatcaagagagcagaaataaccgaattagttgtcgaatatatgattgaacgatttatctcctttagcgtcattgtaaaggaatggggtatggagacattcattgaggacgaggataatattagatttactgtctacctaaatttcgttgaaccggaagaattgaatcttagtaagtttatgatggttcttccgggtgccgccaacaagggcaagattagtaaattcaagattcctatctctgattatacgggttatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagttaataaattcaagttcggtgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctttgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgacttcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagtttagatttaacgttaaagatgagcataaacataataaacaaaattacaatcaaacctataacattaatatcaaacaatccaaaaaatgaaatcagtggagtagtaaacgcgtacataactcctggataacgtttagcagctgccgttcctattctagaccaaaaattcggtttcatgttttcgaagcggtgttctgcaacaagtcggggatcgtgttctacatatttggcggcgttatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacatttacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacatcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagttcaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaaaaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttaattggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacaaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctctctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagtgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataagccgctattgaaactgacggatgattctagtcccgaagaatttctgttcaacaaactaagtgaacgaaaggtatatgaatgtatcaaacagtttggtattagaatcaaggatctccgaacgtatggagtcaattatacgtttttatataatttttggacaaatgtaaagtccatatctcctcttccatcaccaaaaaagttaatagcgttaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaaaaccgataaatggaaatggataagcgtatgaaatctctcgcaatgacagctttcttcggagagctaaacacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgtggatattattaaagaggatattagcgaatatatcaaaactactccccgtcttaaacgatttataaaaaaataccgcaatagatcagatactcgcatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcatcttctactattgcgacgtatatagacgctttagcgaagaatgcttcggaattagaacagaggtctaccgcatacgaaataaataatgaattggaactagtatttattaagccgccattaattactttgacaaatgtagtgaatatctctacgattcaggaatcgtttattcgatttaccgttactaataaggaaggtgtcaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccaatctaaaagttctttgttgcacgctattaatcatccaaagtcaaggcctaatacatctctggaaatagaattcacacctagagacaatgaaaaagttccatatgatgaactaataaaggaattgacgactctatcacgtcatatatttatggcttctccagagaatgtaattctttctccgcctattaacgcacctataaagacttttatgttgcctaaacaagatatagtaggtctggatctggaaaatctatatgccgtaactaagactgacggcattcctataactatcagagttacatcaaacgggttgtattgttattttacacatcttgggtatattattagatatccagttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatatgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaatcgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagtttgataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagatcaaaattaacaaaattaaaggagcatgtatttttttctgaatatattgtgactccagatacatatggatctttatgcgtcgaattaaatgggtctagttttcagcacggtggtagatatatagaggtggaggaatttatagatgctggaagacaagttagatggtgttctacatccaatcatatatctgaagatatacccgaagatatacacactgataaatttgtcatttatgatatatacacttttgacgctttcaagaataaacgattggtattcgtacaggtacctccgtcgttaggagatgatagctatttgactaatccgttattgtctccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggcaaagttagaatccccggtaactaccatagtgggatatcatccagcggctagagaccgtcaattcgagaaagatcgatcatttgaaattatcaacgttttactggaattagacaacaaggtacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaacaagatcgatagacactgccgtatataggagaaaaacaactcttcgggttgtaggtactaggaaaaatccaaattgcgacactattcatgtaatgcaaccacctcatgataatatagaagattacctattcacttacgtggatatgaacaacaatagttattacttttctctacaacgacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtggagaccgatacctatccggataaacttccgtttaaaaatggtgtattggacctggtagacggaatgttttactctggagatgatgctaaaaaatatatgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcatgtagtgggtcaaagaaaatcagatctgataatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacagaaaatatcatgttcctattatgaaactatatcctacacccgaagagattcctgactttgcattctatctcaaaataggtactctgttggtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaattatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttctactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggcagtcaattgatgtttttgttttcgtcaaacattatgtccgaatcctatactctgaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttgtatctaaaatttaagactaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggataccttccagttacattggagccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgttgactcataaaaaagagaatagcggtaagtataaacacgaatactatggcaataattgcgaatgttttattcccttcgatatatttttgataatatgaaaaacatgtctctctcaaatcggacaaccatctcataaaatagttctcgcgcgctggagaggtagttgctgctcgtataatctccccagaataatatacttgcgtgtcgtcgttcaatttatacggatttctatagttctctgttatataatgcggttttccatcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggtggatctaatggaatccaattgattaactatcttttgaaaatatacatttttatgatccgatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatacgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcattccaagcgatattatctcaacaaaattcagattctatctttagagtatccactaaactattacggtttatgtactacaatgaactaagagaaatctttagacggttgagaaaaggttctatcaacgatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtctagaaagaaacgattatttctgaattattccaattatttgtccaaacaggaaagaagtatactatcgtcatttttttctctagatccagctactactgataatgatagaatagatgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctttaacgagtgatcaaatcattgatacatttaaaagtaatcatgaaatcaaggatctaatatttttagatccgaattcaggtaatggactccaatacgaaattgcaaaatatgctctagatactgcaaaactcaaatgttatggccatagaggatgttattacgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatgtacgaacataggcctcctagtttggagactaattctttctcatcaactagacgtttattctcaaatagcgattggtgttgtaaggatcctggtcgtagtaagttaaccaacatggtgaattcttgcacactattaacgataggtgtagccgataaacaaatcatcttatggttttttaatgcgatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccaacacccgtttcatggaacaataaaagagaatgcatactgtctaatcctaagaaaactcttgctacaaaatgttgataatccttgaggcgtactacgtctgttcccatcatttcaacaggcatattagtagttctgcgcaatgcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgtgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctaaagacaagttaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattggccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctcaacaatctcggcagactccggataaccagtcggtgggccatcactaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaaccgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatataaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaagtttattgtatttataaccttttccttatcttcatagaatactaaaggcaacaaagaaatttttggttcttctctaagagctacgtgagacttaaccatagaagccaacgaatccctacatattttagaacagaaataccctacttcaccacccttgtatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacatactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttgtgtctacaaccgctacataatcgtagattcatgttaacactctacgtatctcgtcgtccaatattttatataaaaacattttatttctagacgttgccagaaaatcctgtaatacttttagttttttgggctgtgaataaagtatcgccctaatatggttaccgtcctccgccaatatagtagttaaattatccgcacatgcaaaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaacagcggactttaacctatacatgataccgtttagcatgatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatatcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgtgtagatgctacttcatctatagaaaccatacaatcctttttgataggctgttgagattgattatttcctgcacgtttaggtttggtacgttgatttctagcccctgcggatataaagtcatcgtctacaatttgggacaatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactaattgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgagaaagtgtaaccgttggagtagtacaagaaatatttccatccgattgttgtgtacatgtagttgttggtaacgtctgagaaggttgggtagatggcggtgtcgtcgtcttttgatctttattaaatttagagataatatcctgaacagcattgctcggcgtcaacgctggaaggagtgaactcgccggcgcatcagtatcttcagacagccaatcaaaaagattagacatatcagatgatgtattagtttgttgtcgtggttttggtgtaggagcagtactactaggtagaagaataggagccggtgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcccctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcattgatgtcgttattctgaaacagtatgattttaggtagcattttcttaacaaagagaacgtatttattgttactcagttgaacagatgatatatccagattactaacgcatctgattccatataccaaactttcagaagaaatggtgtacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatactatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtataaaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaagataatagggagaaatgacattttggattctgttacgactttaccaaaattaaggatatacggacttactatctttttctcaacgtcgatttgatgaacacacgatgaaaatgtgcttctatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagggtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgaaagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacaacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatttccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattacttcccataatggatcttctagtagtcaccttaaagcccattgatgcaaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcctgtctcagaaagtcctatatgcatgatagatttatctttcctgggaaactctcgtatagtcatagatgaaatactcttcaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgtggtttctacctatgtctacaaattgcacgtttggaagcgccacggttacattcactgcagcattttgaggatcgcgagtatgaagtacgatgttattgtttactggtatatctggaaagaattctaccagtctaggaataagagattgatatcgcatagaaatacaaaagttcataatctcatcatctaagagcattttgttaccattgtaataaatatccactctgtcatatgtataaatgaagtactgttcaaacatgatgagatgtttatatgttggcatagtagtgagatctacgtttggtaatggcaatgtattaagattaactccataatgtctagcagcatctgcgatgttataagcgttgtcaaagcggggtcgatcttgtgctgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattctccggccactattatcgaacgagtacaacctcatactactattattgacgatactccacctcctacgtttcgtagagagttattgatatcggaacaacgtcaacaacgagaaaaaagatttaatattacagtatcgaaaaatgctgaagcaataatggaatctagatctatgatatcttctatgccaacacaaacaccatccttgggagtagtttatgataaagataaaagaattcagatgttggaggatgaagtggttaatcttagaaatcaacgatctaatacaaaatcatctgataatttagataattttaccagaatactatttggtaagactccgtataaatcaacagaagttaataagcgtatagccatcgttaattatgcaaatttgaacgggtctcccttatcagtcgaggacttggatgtttgttcagaggatgaaatagatagaatctataaaacgattaaacaatatcacgaaagtagaaaacgaaaaattatcgtcactaacgtgattattattgtcataaatattatcgagcaagcattgctaaaactcggatttgaagaaatcaaaggactgagtaccgatatcacttcagaaattatcgatgtggagatcggagatgactgcgatgctgtagcatcaaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtaggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggatttggattttgtgggttcttgatcttattatacagcgcatataggatggcgacggtaactgctacgcaaataccgatcaacaaaagaataccaatcatttattgacaataacttcactattgatcaagtatgcaatatatcatcttttcactaaataagtagtaataatgattcaacaatgtcgagatatatggacgataataatttagttcatggaaatatcgctatgattggtatgaatgactccgctaactctgtggggcgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatatccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgactctacccgatgaatcggacaatgtactgggccatgtagaataaattatcaacgaattatcgtctacgaacatttatatcatttgttttaattttagtacgcgaataaatagatataaaatagaaaataacagatattacaaccaatgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttctttgaacatcttgattataatataaccattttctatctctagattcgtcggtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcatcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtggcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttaattctattaagagtaacggctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacatacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcattatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacattactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatctatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccagctaaccgaatttattgtaacagtattattaatattgccaagttatccgatctaaaaaaaactatctatgcggtagatagtttttttgagccatattccacagacaatattagacatatggtaaaacgactagatggaccatctaataaatatcatatatatactgagaagttattatctgtagacgagcctagaaatcaacttattcttgataccctggtagaagaattcaagtcaggaactattaatcgaattttagttattactaaactacgtgaacatatggtattcttctacaaacgattattagattttttcggatcagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgtatgtacaacatcctccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcggctcttcattccggaacgcacattggtgctatccatttaggtagtaaaaaataagtcagaatatgccctatagcacgatcgtgcaaaacctggtatatcgtctctatctttatcacaatatagtgtatcgacatttttattattattgacctcgtttatcttggaacatggaatgggaacatttttgttatcaacggccatctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgaaattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggatattacattttcttaccggtatattttggaagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttagacggcaagttgtagactttttcaaattctcgttcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatatcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtacgtcaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcatgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaggatatcatccaaaacgagtactttaaagaagtagctaatgttgtaaaccacgtacttacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactgattcagaaatggatcaacgactcggatataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgtcgaatatatcatcgacaaagacatttataacggtcaatattgttttgctgtctcaatatttatctagagtgagtctagaattcattagacgtagcttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgatcaacgagttcaaatatgaaatgctgcataactttttacctcatatgaactatacacccgatcaactaaagggattttatatgatatctttactaagaaagtttctctactgtatctaccacacttctagatatccagatagagattcgatggtttgtcatcgtatactaacatacggcaaatattttgagacgttggcacatgatgaattagagaattacataggcaacatccgaaacgatatcatgaacaatcacaagaacagaggcacttacgcggtaaacattcatgtactaacaactcctggacttaatcatgcattttctagtctattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcggacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcactagtgggaatcaatcacaattctggacccagagctattcttggatgtgctcaagctaaacaagctatctcttgtctgagctcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatattgttacagccaagaaacatcaagtagaaattccgttggaaaactttaataacaaagaaagagataggtctaacgcctattcaaaattagaaagtaatggattagttagactgaatgctttcttggaatccggagacgctatagcacgaaatatctcatcaagaactcttgaagatgattttgctagagataatcagattagctttgatgtttccgaaaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatatcgcggatgaaacggaacttccatacgatgaaaatggtatcacaccagatgtcattattaattctacatccatcttctctagaaaaactatatctatgttgatagaggttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtctgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagttaaattagatttcgaacgaaggcctccttcgttttataaaccattagataaagttgatctcaaaccgtcttttctggtgtaatattctagtttggtagtagatacatatcaatatcatcaaattcgagatccgaattataaaatgggcgtggattgttaactatagaatcggacgtctgatattcgaaaatctgtggagttttaggttttggtggaggtgtaactgctacttgggatactgaagtctgatattcagaaagctgggggatgttctggttcgacatccaccgatggtgtcacatcactaatcggttcggtaacgtctgtggacgatggaggcaccacttctacaggttctggttctttatcctcagtcatcaacggagctacttcaatgcgaggaaatgtataatttggtaatggtttctcatgtggatctgaagaagaggtaagatatctactagaaagataccgatcacgttctagttctcttttgtagaacttaactttttctttctccgcatctagttgatattccaacctcttcacgttactacgttcagattccaattcacgttcgcatgggttacctccgcagtttttacgagcgatttcacgttcagccttcatgcgtcttatagcatgaattcgcttatcgttatcgggtttagcttctgtcaccttagcaattccttttttattaaactctacataatcatatccatttctattgtttgttctaatataaacgagtatagcatcattgctaaatttttcaatagtatcgaaaacagaatatcctaaaccatataatatatattcaggaacactcaaactaaatgtccaggattctcctaaatacgtaaactttaatagtgcgaaatcattcaaaaatctaccacttatagatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgatcattaataagatttttatcattgctcgttatttcagaatcgtatatataaggagtaccatcgtgattcttaccagatattatacaaaatactatatataaaatatattgacccacgttagtaatcatgtaaatgtttaacgttttaaattttgtattcaatgatccattatcatacgctagcatggtcttatgatattcattctttaaaatataatattgtgttagccattgcattggggctcctaatggagattttttattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagccgttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtagctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttttactttctaatatagcgtttagattctttttcatgtgcgaatattgatttactaaaatatcgatgtttaacttttgttctatgacgtccttatcagcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgagatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcacctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcccgttaaaaccattctaaacggcatttttaataaattttctcttgaaaattgtttttcttggaaacaattcataattatatttacagttactaaattaatttgataataaatcaaaatatggaaaactaaggtcgttagtagggaggagaacaaagaaggcacatcgtgacataaataacatttattatcatgatgacaccagaaaacgacgaagagcagacatctgtgttctccgctactgtttacggagacaaaattcaaggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgattacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgttgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgtcatggcgcctagcacagaacacatttacgatagtgttgctggaagcacgctgctaataaataatgatcgtaatgaacagactatttatcagaacactacagtagtaattaatgagacggagactgttgaagtacttaatgaagataccaaacagaatcctaactattcatccaatcctttcgtaaattataataaaaccagtatttgtagcaagtcaaatccgttcattacagaactcaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattccccatagactatcgactattatactctgtattagttctgtcggaggatgtgttatctctatagataatgacatcaatgacaaaaatattctaacatttcccattgatcatgctgtaatcatatccccactgagtaaatgtgtcgtagttagcaagggtcctacaaccatattggttgttaaagcggatatacccagcaaacgattggtaacatcgtttacaaacgacatactgtatgtaaacaatctgtcactgattaattatttgccgttgtctgtattcattattagacgagtcaccgactatttggatagacacatatgcgatcagatatttgcgaataataagtggtattccattataaccatcgacgataagcaatatcctattccatcaaactgtataggtatgtcctctgccaagtacataaattctagcatcgagcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgataaaaagaataagaataagatcaaggattatatggaacacgattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagtaccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagatggtaacgtcatcatcaacaatccaataatatgccggagagtaaacattgacggataaaacaaaaatgctccgcataactctatcatggcaataacacaaccaaatacttgtaagattcctaaattagtagaaaatacaacggatatcgatgtataagtgatctcgagaaataataagaataaagtaatgcccgtaaagataaacatcaacattgtttggtaatcattaaaccaattagtatgaagttgaactaatttcacagtagattttattccagtattatccccgcatgtatacgtacctggtaagatatctttatattccataatcaatgagacatcactatctgataacgaatgaagtctagcactagtatgccatttacttaatatggtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatatcacaacatctataaaagtagaggatgcggataaggatacattagtatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttatacacggcggataacgtaattccaaaagatggtttacgaggagcattcgtcgataaagacggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaaaaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaacttcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgttggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaacctgggaggaaggacgtaatgcatgcaaagctctaaatccaaattcggatctaattaagatagagactccaaacgagttaagttttttaagaagcattagacgcggatattgggtaggagaatccgaaatattaaaccagacaaccccatataattttatagctaagaatgccacgaagaatggaactaaaaaacggaaatatatttgtagcacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccacactcatcgtatattttgacgtatgtagtcacatcgtttacgcaatagtcagactgtagttctatcatgcttcctacattagaaggaggaacagttttaaagtctcttggttttaatctattaccgttagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaattagtgttcgagtgagtcggattatgtgagtactggattgtatattttattttatattttgtaataagaataaaatgctaatgtcaagtttattccaatagatgtcttattaaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgcgcaactggtaattaaaataaaaagtaatattcatatgtagtatcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgttacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcataatacgatctataaaaataagtatataaatactttttatttactgtactcttactgtgtagtggtgataccctactcgattatttttttaaaaaaatacttattctgattcttctagccatttccgtgttcgttcgaatgccacatcgacgttaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaattctagatccttgttctattcccaatggtttcatcaatagaagattaaacatatcgtacgaacacgatggagagtaatcgtagcaaaagtaagcatttcctttaatctcagatcccggatactggatatattttgcagccaacacgtgcatccatgcaacatttcctacatatacccggctatgcaccgcgtcatcatcgactgtacgatacataatgttaccgtgttgcttacattgctcgtaaaagactttcgtcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttatttggtcctattgcttccatgctactagtatagatcaaatacttgattcctaggtccacacaagctgccaatatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatctacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaagtataggtgtatggcattagccgaacatatatctgatagtattccaatatctgagctatctagactacgatacaatctatgtaagtatctacgcgggcacactgagagcatagaggatgaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaaaaaaattatactgtaacacaatgaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagacgacgatttctgaattatttcatatatccctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacaaaaatgtctcgtggggcattaatcgtttttgaaggattggacaaatctggaaaaacaacacaatgtatgaacatcatggaatcaataccttcaaacacaataaaataccttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagatctatcagactgagttgattaattcattagacgacaatgaaattatcgattgtatagttaataagtttatgagcttttataaggataacctagaaaatatagtagatgctatcatcactctaaaatatataatgaataatccagattttaaaactacgtatgcagaagtactcggttccagaatagcggatatagatattaaacaagtgatacgtgagaatatactacaattgtctaatgatatccgcgaacgatatttgtgaaaaatattaaaaaaaaatactttttttattaaatgacgtcgcttcgcgaatttagaaaattatgctgtgatatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatatcgcatccgtttgtacatgtaatgatttaaaatgtgtagtcatgcttattgataaagatctaaaaattaaagcgggccctcggtacgtacttaacgctattagtcctcatgcctatgatgtgtttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcttactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccaaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaattaaaataacactatttagttggtggtcgccatggatggtgttattgtatactgtctaaacgcgttagtaaaacatggcgaggaaataaatcatataaaaaatgatttcatgattaaaccatgttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgccattcctgttattatatccataggaaaggatagagatgtttgtgaactattaatctcatctgataaagcgtgtgcgtgtatagagttaaattcatataaagtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcaatagctgataatagaacttacgcaaatattagcaaaaatatattagacaatactacaattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactttatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagaagatcatacagttacagacactgtctcatacactacagtaagtacatcatctggaattgtcactactaaatcaaccaccgatgatgcggatctttatgatacgtacaatgataatgatacagtaccatcaactactgtaggcggtagtacaacctctattagcaattataaaaccaaggactttgtagaaatatttggtattaccgcattaattatattgtcggccgtggcaatattctgtattacatattatatatataataaacgttcacgtaaatacaaaacagagaacaaagtctagatttttgacttacataaatgtctgggatagtaaaatctatcatattgagcgggccatctggtttaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaacatactgagtttttaggaaatatttacggaacttctaaaactgctgtgaatacagcggctattaataatcgtatttgtgtgatggatctaaacatcgacggtgttagaagttttaaaaatacttacctaatgccttactcggtgtatataagacctacctctcttaaaatggttgagaccaagcttcgttgtagaaacactgaagcggatgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtggctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggatttggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttggatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggttgatgtaaaatttttgtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcacatatcgccacaaaaactactatgctctaagcggaatcgggtacgagagtctagacttgtgtttggaaggagtagggattcatcatcacgtacttgaaacagaaaacgctgtatatggaaaagttcaacatgattattctactatcaaagagaaggccaaagaaatgaatgcactcagttcaggacctatcatcgattaccacgtctggataggagattgtatctgtcaagttactgctgtggacgtacatggaaaggaaattatgagaatgagattcaaaaagggtgcggtgcttccgatcccaaatctggtaaaagttaaacttggggagaatgatacagaaaatctttcttctactatatcggcggcaccatcgaggtaaccacctctctggaagacagtgtgaatcatgtactcatgaaacgtttggaatctatacgccatatgtggtctgttgtatatgatcattttgatattgtgaatggtaaagaatgctgttatgtgcatacgcatttgtctaatcaaaatcttataccgagtactgtaaaaacaaatttgtacatgaagactatgggatcatgcattcaaatgagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtaaatctattaatgttaaacatacatctgtttcagctaagcaactaagaacacgtatactctcatcttttgccaacacagagggtggatatttgttcattggagttgataataatacacacaaagtatttggattcacggtgggttacgactacctcagactgatagagaatgatatagaaaagcatatcaaaagactttgtgttgtgtatttctgtgagaagaaagaggacatcaagtacacgtgtcgattcatcaagtggggatgaggctacctcgacatacgtgtgcgctatcaaagtggaaagatgctgttgtgctgtgtttgcagattggccagaatcatggtatcaagaagtattctccagatgaataggtgtcacatataaaattttaattaatgtaactatagagaacaaataataggttgtaatatcatatagacaataactaacaattaattagtaactgttatctctttttaactaactaactatacctattaatacatcgtaattatagttcttaacatctattaatcattgattcgcttctttaattttttataaaccaacattgttaattgaaaagggataacatgttacagaatataaattatatatggattttttttaaaaaggaaatacttgactggagtgtatatttatctcttcattatataacacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcaggttatcatcatccattaatataaaagaatatgtatatcaattagttaataatgatcatccagataataggataagactaatgcttgaaaatggacgtagaacaagacattttttgtcctatatatcagatacagttaatatctatatatgtattttatatagatgccgaagacagttacggttgtacattattacatagatgtatatatcactataagaaatcagaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatttacgacgctgtcagttataatgcgtataatacgttggtctatctattaaacagaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacaatcactacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaagtgcactagtctcgacgtatacggaagtcgtgtacgtaatatcatagcatctattagatatcgtcagagattaattagtctattatccaagaagctggatcctggagataaatggtcgtgttttcctaacgaaataaaatataacgataacgaactgtccacatatctaaaaatcttataaacactattaaaatataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaataataaccagaaagttacgtttacatgtgatcagggatatcattcttcggatccaaatgctgtctgcgaaacagataaatggaaatacgaaaatccatgcaaaaaaatgtgcacagtttctgattacatctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatatgccgtctctatctaacggattaatttccggatctacattttctatcggtggcgttatacatcttagttgtaaaagtggttttacactaacggggtctccatcatccacatgtatcgacggtaaatggaatcccgtactcccaacatgtgtacgatctaacgaaaaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtgaatataaatccgttaaaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattaactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaatacacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatccaagtggatatattagagaagcactcgttattaataccagtagtaatagtgattccattgataaagaagttatagaatgtatcagtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactctataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcaaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaagacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattcttttttttatagagtgtggtagtgttacggatatttaatattagactatctctatcgcgctacacgaccaatatcgattactatggatatcttctatgaaaggagagaatgtattcatttctccagcgtcaatctcgtcagtattgacaatactgtattatggagctaatggatccactgctgaacagctatcgaaatatgtagaaacggaggagaacacggataaggttagcgctcaaaatatctcattcaaatccataaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatcaccaacggaaatggtagacgtaagtatgatgtctatgtacggcgagctatttaatcacgcatctgtaaaagaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggttcgtataatcttgtggatactctagtaaagttgggactgacagaggtgttctattcaactggcgattatagcaatatgtgtaattcagatgtgagtgtcgacgctatgatccacaaaacgtatatagatgtcaatgaagagtatacagaagcagctgcagcaacttctgtactagtggcagactgtgcatcaacagttacaaatgagttctgtgcagatcatccgttcatctatgtgattaggcatgttgatggcaaaattcttttcgttggtagatattgctctccaacaactaattgttaaccattttttttaaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttctttcttctcttctccctttcttctcttctcccttcctccctcttctccctttcccagaaacaaacttttttacccactataaaataaaatgagtatactacctgttatatttctttctatatttttttattcttcattcgttcagacttttaacgcgcctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacagaggtaaaacatataacgtaaccagaattgtaaaattagaggtacgggataaaataataccttctactatgcaattaccagatggcattgtaacttcaataggtagtaatttgactattgcgtgtagagtatcgttgagacctcccacaacggatgcagacgtcttttggataagtaatggtatgtattacgaagaagatgatggggacggaaacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcatgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcgtttattaatatcgggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaaccgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcgaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatggagtggatgtaacgatgaaaaccagtagcggacgtatgcctgtttatatattgcttactagatgttgtaatatttcacatgatgtagtgatagatatgatagacaaagataaaaaccacttattacatagagactattccaacctactactagagtatataaaatctcgttacatgttattgaaggaagaggatatcgatgagaacatagtatccactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcgaaatatgtaataatcatggattaacgcctatactatgttatataacttccgactacatacaacacgatattcttgttatgttaatacatcactatgaaacaaatgttggagaaatgccgatagatgagcgtcgtataatcgtattcgagtttatcaaaacatattctacacgtccggcagattcgataacttatttgatgaataggtttaaaaatataaatatttatacccgctatgaaggaaagacattattacacgtagcatgtgaatataataatacacacgtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatctttcgtcgcttatcatactagtcatatcctaaatgttgatcatattccaccaaatgattgtgaaagagattgagattaaatcgtctaacaaacaattagtttttatgacattaacatataataaataaattaatcattattgacttaacgatgacgaaagttatcatcatcttaggattcttgattattaatacaaattcattgtctatgaaatgtgaacaaggtgtctcatattataattcacaagaattaaagtgttgtaaactatgtaagccaggaacatattcagatcatcgatgtgataaatacagcgataccatttgtggacattgtccgagtgacacattcacgtcaatatataatcgttctccttggtgtcatagttgtagaggtccatgtggtactaatcgagtagaggtcacaccttgtacacctaccacaaatagaatctgtcattgtgactcgaatagttattgtctccttaaagcttctgatggtaactgtgttacatgtgctcctaaaacaaaatgtggtcgtgggtatggaaagaaaggagaagatgaaatgggtaataccatttgtaagaaatgtcggaagggtacttattcagatattgtatctgactctgatcaatgtaaaccaatgacaagataagacttactcgcatctactggatagacataaaatatcctcctcgtaataatgaaatataatatacactaattattaatatcaataacaatcgagtattaatatataggtcatttttaaatcccttttgggttccgtcccaaacggcgtttcggtctgcgtcgccgccatggccatgccgagcctctccgcgtgctcctccatcgaggacgacttcaactatggcagctcggtggcgtctgccagcgtgcacatacgaatggcatttctaagaaaagtctacggtatcctttgtctacaatttcttttaacaacggcaacaactgcagtatttttatactttgactgcatgcggacatttatacaagggagtcctgttctaatattggcatcaatgttcggatctataggcttgattttcgcattgactttacacagacataaacatcccctgaatctgtacctgctttgtggatttacactgtcggaatctctaacgctggcctctgttgttactttctatgatgtgcatgtcgttatgcaagctttcatgctgactactgcagcgtttcttgctctgactacatatactctacaatcaaagagagatttcagtaaacttggagcaggattgtttgctgctttgtggattttaattttgtcaggactcttggggatatttgtgcaaaatgagacagtgaagctggtcctgtctgcttttggggcccttgtattctgtggattcattatctatgacacgcactcactaatacataagctctcgcctgaagagtatgtgttagcctctatcaatctctacttggatatcatcaatctgttcttgcatctgttgcagcttttggaagtatctaataagaaataaagtttaaaatagaattaataaaaacatataggtcattttttaaacatggattggaaaccaaggtagttagttaatacacacaagatatatttttttcacatcatccacccatgggtaacaccaaggttgttagttaataatatacaagatattttttctcactctgatccatgtaaaccaaggacgagataagacactctcattcctcatccacaacccattaaaaaaatggaaattaaagccctctattagcataaacggctacaggtctaccttcacaatggcctttccttgtgcccagttcagaccctgtcattgccacgctactaaggactccctgaataccgtggccgacgtcagacattgtctgactgaatacatcctgtgggtttctcatagatggacccatagagaaagcgcagggcctctctacaggcttctcatctctttcagaactgatgcaacggagctctttggtggtgagttgaaggattcacttccgtgggacaattgcgtggagatcattaaatgtttcatcagaaatgactccatgaaaaccgccaaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaaatctccttcatgctctctcactacactttttatcatcttatgaggaatgattgccttcgtgaaataggaataattagcaccagaatagctatggattattgtggtagagagtgcactattctatgtcgtctactggatgaagatgtgacgtacaaaaaaataaaaccagagattgaaacgtgtcacaacttatcaaaacatatagatagacgaggaaacaatgcgctacattgttacgtcttcaataaatgcgatacagacattaagattgttcggctgttactctctcgcggagtcgagagactttgtagaaacaacgaaggattaactccgctaggagcatacagtaagcatagatacgtcaaatctcagattgtgcatctactgatatccagctattcgaattcctctaacgaactcaagtcgaatataaatgatttcgatctgtattcgtataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcgataacaatgtttccatccatggcagagacgaaggaggatctttacccatccaatactactggtcttgctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgtacaagccatgttgataaactacttacattacggcgatatggtcgttcgatgcatgttagataacggacaacaactatcctctgcacgactactttgttaataataatctcgtcgatgtaaacgtcgtaaggtttatcgtggaaaatatggacacgcggctgtaaatcacgtatcgaacaatggccgtctatgtatgtacggtctgatattatcgagatttaataattgcgggtatcactgttatgaaaccatactgatagatgtatttgatatactaagcaagtacatggatgatatagatatgatcgataactctactatattacgcggtcgatgtcaataatatacaatttgcaaagcggttattggaatatggagcgagtgttacaacatcacgctcgataatcaatacggccatccagaaaagcagttacagaagagaaaacaaaacgaggatagttgatttattactgagttaccatcccactctagagactatgattgacgcatttaatagagatatacgctatctatatcctgaaccattattcgcctgtatcagatacgccttaatcctagatgatgattttccttctaaagtaaagtatgatatctccggtcgtcataaggaactaaagcgctatagagcagacattaatagaatgaagaatgtctacatatcaggcgtctccatgtttgatatattctttaaacgaagcaaacgccacagactgagatacgcaaagaatccgacatcaaatggtacaaaaaagaactaacgtccatcattacagaaactgtaaagaacaatgagaggatcgactccatagtggacaacattaatacagacgataacttgatttcgaaattacccatggagatactttattactccattaaataatttatcatggagcgataatgtcctgtttcatttgtttccatgacatattacaaaatcgattccgtccaagatgataaaaacatttaccggcatcataaacacggagtttattttatatgtctcgcataaacattactaaaaaaatatattgttctgtttttctttcacatctttaattatgaaaaagtaaatcattatgagatggacgagattgtgagcatcgttcgcgatagtatgtggtttatacctaacgtatttatggacgacggtaagaatgaaggtcacgtttctgtcaacaatgtctgtcatatgtattttacgttctttgatgtggatacatcgtctcatctgtttaagctagttattaaacactgcgatctgaataaacgaggtaactctccattacattgctatacgatgaatacacgatttaatccatctgtattaaagatattgttacaccacggcatgcgtaactttgatagcaaggatgaccactatcaatcgataacaagatctttgatatactaacggacaccattgatgactttagtaaatcatccgatctattgctgtgttatcttagatataaattcaatgggagcttaaactattacgttctgtacaaaggatccgaccctaattgcgccgacgaggatgaactcacttctcttcattactactgtaaacacatatccacgttctacgaaagcaattattacaagtcaagtcacactaagatgcgagccgagaagcgattcatctacgcgataatagattatggagcaaacattaacgcggttacacacttaccttcaacagtataccaaacatagtcctcgtgtggtgtatgctcttttatctcgaggatacgtaataatcttgattgtacacccatcatggaacgattgtgcaacaggtcatattctcataatgttactcaattggcacgaacaaaaggaagaaggacaacatctactttatctattcataaaacataatcaaggatacactctcaatatactacggtatctattagataggttcgacattcagaaagacgaatactataataccgcctttcaaaattgtaacaacaatgttgcctcatacatcggatacgacatcaaccttccgactaaagacggtattcgacttggtgtttgaaaacagaaacatcatatacaaggcggatgttgtgaatgacatcatccaccacagactgaaagtatctctacctatgattaaatcgttgttctacaagatgtctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgccttaaagagattcgaatctccgacaccgacctgtatacggtatcacagctatcttaaagccatacattcagacagacacatttcatttcccatgtacgacgatctcatagaacagtgccatctatcgatggagcgtaaaagtaaactcgtcgacaaagcactcaataaattagagtctaccatcggtcaatctagactatcgtatttgcctccggaaattatgcgcaatatcatctaaacagtatgttgtacggaaagaaccattacaaatattatccatgatagaaagaaaatatctatatgattggagaagtaggaaacaggaacaagacgacgattactacattattaaatcatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacgatgtacgccgtgtggttcgggtaccttcacatctcgcaataatcatttacccgcttgtctaagttgtaacggaagacgcgatcgtgtaacacgactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacctttaactatatcgatgtggaaattaatctgtatcccgtcaacgacacgtcgtgtactcggacgaccactaccggtctcagcgaatccatctcaacgtcggaactaactattactatgaatcataaagactgcgatcccgtctttcgtgatggatacttctccgttcttaataaggtagcgacttcaggtttctttacaggagaaaggtgtgcactctgaatttcgagattaaatgcaataacaaagattcttcctccaaacagttaacgaaagcaaagaatgatactatcatgccgcattcggagacagtaactctagtgggcgacatctatatactatatagtaataccaatactcaagactacgaaactgatacaatctcttatcatgtgggtaatgttctcgatgtcgatagccatatgcccggtagttgcgatatacataaactgatcactaattccaaacccacccactttttatagtaagtttttcacccataaataataaatacaataattaatttctcgtaaaagtagaaaatatattctaatttattgcacggtaaggaagtagaatcataaagaacagtactcaatcaatagcaattatgaaacaatatatcgtactggcatgcatgtgcctggcggcagctgctatgcctgccagtcttcagcaatcatcctcatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtcccaggacaaggtaaggactctcccgcgatcactcatgaagaagctcttgctatgatcaaagactgtgaggtgtctatcgacatcagatgtagcgaagaagagaaagacagcgacatcaagacccatccagtactcgggtctaacatctctcataagaaagtgagttacgaagatatcatcggttcaacgatcgtcgatacaaaatgtgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagggtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaatattaaacctctttctgatggtgtcactaaaatatttttattctcattctcattttctctttctctcttcaatggagtcataaaatatttttattctctttctctcttcgatggtctcacaaaaatattaaacctctttctgatggtgtcactaaaatatttttattctcattctcattttctctttctctcttcaatggagtcataaaatatttttattctctttctctcttcgatggtctcacaaaaatattaaacctctttctgatggagtcgtaaaaaagttttatctctttctctcttcgatggtttcactaaaatattttttattctctttctgatgcatcaactatttcttaaacaataacgtccaacaacatatactcgtcgagcttatcaacatcccctatgcccatctaggttaccagacaattgtatatcataaaataatgtttataatttacacgttaaaatcatataataaaacgtagatcgtataatattttttggtatataaatgatctagtaaaatccatgtaggggatactgctcacattttttctttggtacaaaatttcacacaagtttttatacagacaaattcttgtccatatattttaaaacattgacttttgtactaagaaaaatatctagactaactatctctttctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggtctctataaagcgatcgatctttcttacactctagagtttcctacagtcatgggtcacacatttttttctagacactaaataaaattagtaaaattaaattaattataaaattatatatataatttactaactttagttagataaattaataatatataagttttagtacattaatattatattttaaatattttatttagtgtctagaaaaaaatgtgtgacccatgactgtaggaaactctagagtgtaagaaagatcgatcgctttatagagaccatcagaaaga

SEQ ID NO: 4 - DNA, 534 bp, Artificial Sequence
  Synethic Polynucleotide
atgaacggcggacatattcagttgataatcggccccatgttttcaggtaaaagtacagaattaattagacgagttaaacgttatcaaatagctcaatataaatgcgtgactataaaatattctaacgataatagatacggaacgggactatggacgcatgataagaataattttgaagcattggaagcaactaaactatgcgatgttttggaattaattacagatttctccgtgataggtatcgatgaaggacagttctttccagacattgttgaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagataaaaataataggaggtaatgatatgtatcaatcggtgtgtagaaagtgttacatcgactcataa

SEQ ID NO: 5 - DNA, 163 bp, Artificial Sequence
  Synthetic Polynucleotide
atgaacggcggacatattcagttgataatcggccccatgttttcaggtaaaagtacagaattaattagacgagttaaacgagctcgtcgacggatccgctagcggccgcggaggtaatgatatgtatcaatcggtgtgtagaaagtgttacatcgactcataa

SEQ ID NO: 6 - DNA, 175 bp, Artificial Sequence
  Synthetic Polynucleotide
gtgaaagctagagaggggtttttaaatggtcatcggtttagtcatattcgtgtctgtggcggccgccatcgtcggtgtgttgtctaacgtattggacatgtttatgtacgtagaagaaaataatgaagaggatgctagaatcaaggaggagcaagaactactgttgctatattga

SEQ ID NO: 7 - DNA, 100 bp, Artificial Sequence
  Synthetic Polynucleotide
gtgaaagctagagaggaagcttgagctcgaggatccgctagcggccgctgaagaggatgctagaatcaaggaggagcaagaactactgttgctatattga

SEQ ID NO: 8 - DNA, 657 bp, Artificial Sequence
  Synthetic Polynucleotide
atgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgcggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaa

SEQ ID NO: 9 - DNA, 102 bp, Artificial Sequence
  Synthetic Polynucleotide
cacaagttcggatctacgggttcgatcacaagttcggatctacgggttaccggtcacaagttcggatctacgggtttcaccacaagttcggatctacgggtt

SEQ ID NO: 10 - DNA, 48 bp, Artificial Sequence
  Synthetic Polynucleotide
cacaagttcggatctacgggtttcaccacaagttcggatctacgggtt

SEQ ID NO: 11 - DNA, 102 bp, Artificial Sequence
  Synthetic Polynucleotide
aaccatacaacctactacctcacgataaccatacaacctactacctcaaccggtaaccatacaacctactacctcatcacaaccatacaacctactacctca

SEQ ID NO: 12 - DNA, 3021 bp, Artificial Sequence
  Synthetic Polynucleotide
atggatgttcggtgcattaattggtttgaaagtcacggtgaaaacagatttttatatctgaaatccagatgtcgaaatggtgagaccgtatttatacgatttcctcattacttttattacgtagtgacggacgaaatatatcagtcattgtctcctcctccatttaatgcgaggccgttgggaaagatgagaactatagacattgacgagacaataagttataatctagatattaaagatagaaaatgctccgtcgcagatatgtggttgatagaagagccaaagaaacgcagcatacaaaatgccaccatggatgaatttctcaatattagttggttttatatttctaacgggatatctccagacggatgttactcgttggacgagcaatatttgacaaagattaacaatggatgttatcattgtgacgatccacgtaactgtttcgctaaaaaaatacctagattcgatatcccaagatcgtacttatttctagatatagagtgtcacttcgataagaagtttccttctgtatttattaacccaatctcgcatacaagttactgttatatcgatttaagtggtaaacgattattgtttacgctcattaatgaagagatgttaacggaacaggaaatacaagaagccgtcgatagaggatgtttgaggatacagtcactaatggaaatggattacgaacgagaactagttttatgttctgaaatagttttgttacgaatagctaaacaattgttggaactaacgttcgactatgtcgttacctttaacggacataactttgatctgagatatattactaatcgtctagagttattaacaggagagaagattatctttagatctccggacaaaaaggaagctgtacatctctgtatttatgagagaaatcagtctagtcataagggagtaggcggcatggccaatactacgtttcacgttaataacaataatggaactatatttttcgatctatattcattcattcaaaaatctgaaaaattggattcgtacaaattggattctatatccaagaacgcgttcagttgcatgggtaaagtattaaatagaggagttagagaaatgacgttcatcggtgacgatactacggacgcgaaaggcaaagccgctgcatttgcaaaggttttaaccacaggtaattatgtgactgttgatgaggatattatatgtaaagtaattcgtaaagatatttgggaaaatggatttaaagtcgtactattatgtcctactttacctaatgatacatataaattatctttcggaaaggatgacgttgatttagctcagatgtataaggattataatctaaacatagctttagatatggctagatactgtattcatgatgcttgtttgtgtcagtatttgtgggagtattatggagtagaaacaaaaacagacgcgggtgcgtcaacatatgtgcttcctcaatccatggtattcgaatatagagcgagtacagtcatcaagggtccactgttaaagctattgttggaaactaaaactatcttagttagatcagaaacaaaacaaaagtttccttatgaaggcggtaaggtatttgctccaaaacaaaaaatgtttagtaataatgtattaatctttgattataacagtctgtatcctaatgtgtgtatctttggaaatctatctccggaaacattagtcggtgtcgttgttagtaccaatagattggaagaagaaataaataatcagctcttgcttcagaaatatccacctcctagatatattacggttcattgtgaacctagactaccgaacctcatctctgaaatagcaattttcgatagatcgatagaaggaaccattcctagactattaagaacatttttggcagagagagccagatataaaaagatgttaaaacaggctaccagttcaactgaaaaggccatctatgattccatgcaatatacgtacaagatagtagccaactcagtatatggtctgatgggatttagaaatagtgctctatactcatacgcttcggctaagagttgcacatccataggacgtagaatgatcttgtatctagaatcggtactaaatggagcagagttatctaacggtatgttacggtttgccaatccattaagtaatccattttatatggacgatagagatattaatccgattgtgaaaacatcgttgcctatagattacagatttcgttttcgtagcgtgtatggagataccgactccgtgtttacagagatagacagtcaagatgtagataagtccatagaaatagcaaaggagttagaacgactgattaataatagagtattgtttaataattttaaaatagagtttgaggcggtatataagaatctgattatgcaatcgaagaagaaatatacaacgatgaaatactcggcatcgtcgaattcaaaatctgtacctgagagaattaataaaggtactagtgaaactagaagagatgtttccaagtttcataagaatatgattaagacatacaagaccagactgtctgagatgttgtctgaaggacggatgaattctaatcaggtatgtatagatattctccgttctttagaaacagatttacgatccgaatttgatagtagatcgtctcctctagaattatttatgttgagtcgaatgcatcactcaaattataaatccgcagataaccctaatatgtatttggttactgaatataataaaaataatccagaaactatagaacttggagaacgatattattttgcatatatttgtccggctaatgtaccatggaccaaaaaacttgtaaatattaaaacatatgaaacaattatcgatagaagttttaaactcggcagtgatcaaagaatattttacgaagtttactttaaacgattgacgtccgaaatagtcaatctattggataataaagttttatgcatctcattctttgaaagaatgtttggttcaaaacctacattttacgaagcataa

SEQ ID NO: 13 - DNA, 1932 bp, Homo sapiens
atggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgagtacctggagatgcgcttcagccgcgcagtgcggctctgcgggactttgcagtacattgtagccacgatgctgtacaccggcatcgtaatctacgcaccggccctcatcctgaaccaagtgaccgggctggacatctgggcgtcgctcctgtccaccggaattatctgcaccttctacacggctgtgggcggcatgaaggctgtggtctggactgatgtgttccaggtcgtggtgatgctaagtggcttctgggttgtcctggcacgcggtgtcatgcttgtgggcgggccccgccaggtgctcacgctggcccagaaccactcccggatcaacctcatggactttaaccctgacccgaggagccgctatacattctggacttttgtggtgggtggcacgttggtgtggctctccatgtatggcgtgaaccaggcgcaggtgcagcgctacgtggcttgccgcacagagaagcaggccaagctggccctgctcatcaaccaggtcggcctgttcctgatcgtgtccagcgctgcctgctgtggcatcgtcatgtttgtgttctacactgactgcgaccctctcctcctggggcgcatctctgccccagaccagtacatgcctctgctggtgctggacatcttcgaagatctgcctggagtccccgggcttttcctggcctgtgcttacagtggcaccctcagcacagcatccaccagcatcaatgctatggctgcagtcactgtagaagacctcatcaaacctcggctgcggagcctggcacccaggaaactcgtgattatctccaaggggctctcactcatctacggatcggcctgtctcaccgtggcagccctgtcctcactgctcggaggaggtgtccttcagggctccttcaccgtcatgggagtcatcagcggccccctgctgggagccttcatcttgggaatgttcctgccggcctgcaacacaccgggcgtcctcgcgggactaggcgcgggcttggcgctgtcgctgtgggtggccttgggcgccacgctgtacccacccagcgagcagaccatgagggtcctgccatcgtcggctgcccgctgcgtggctctctcagtcaacgcctctggcctcctggacccggctctcctccctgctaacgactccagcagggcccccagctcaggaatggacgccagccgacccgccttagctgacagcttctatgccatctcctatctctattacggtgccctgggcacgctgaccactgtgctgtgcggagccctcatcagctgcctgacaggccccaccaagcgcagcaccctggccccgggattgttgtggtgggacctcgcacggcagacagcatcagtggcccccaaggaagaagtggccatcctggatgacaacttggtcaagggtcctgaagaactccccactggaaacaagaagccccctggcttcctgcccaccaatgaggatcgtctgtttttcttggggcagaaggagctggagggggctggctcttggaccccctgtgttggacatgatggtggtcgagaccagcaggagacaaacctctga

SEQ ID NO: 14 - DNA, 717 bp, Artificial Sequence
  Synthetic Polynucleotide
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttgacctacggcgtgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaaggtctatatcaccgccgacaagcagaagaacggcatcaaggtgaacttcaagacccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtactga

SEQ ID NO: 15 - DNA, 1653 bp, Artificial Sequence
  Synthetic Polynucleotide
atggaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagatcgccgtgtga

SEQ ID NO: 16 - DNA, 711 bp, Artificial Sequence
  Synthetic Polynucleotide
atggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtga

SEQ ID NO: 17 - DNA, 813 bp, Artificial Sequence
  Synthetic Polynucleotide
atggaaacggatacattgcttttgtgggtacttctgctctgggtgccgggaagtacaggagacgaggttcaactcgtcgaatcaggcggaggacttgtccagccggggggttctctgcggctgagttgtgcagcttcaggattcacattctcagactcatggatacattgggtgcggcaagcacctggaaaagggctggaatgggtggcttggataagtccgtacggagggagtacttattacgcggacagtgtaaagggcaggttcacgattagtgccgacacgagtaagaataccgcctatctgcaaatgaacagtttgcgagcggaggacacagcagtatattattgcgctagacggcattggccgggaggcttcgattattggggacagggtactctcgttacggtgagctcaggtggaggagggagtgggggtggcggctccggcggtggtggttcagacattcagatgacccagtccccgagctctctctccgcgtctgtgggtgatcgagtaaccatcacttgtagagcaagccaagacgtgtcaacagccgtagcgtggtaccaacagaagcctgggaaggctcccaagctcctgatatattctgcaagtttcttgtatagtggtgtgcccagtaggttttcaggaagcggatctggtactgacttcacacttactatttcatccttgcaacctgaggacttcgcaacctattattgccagcaatacttgtaccaccccgcaacttttggccagggtaccaaggtagagatcaaacgggactataaagacgacgatgataagtaa

SEQ ID NO: 18 - DNA, 70 bp, Artificial Sequence
  Synthetic Polynucleotide
aaaaattgaaaataaatacaaaggttcttgagggttgtgttaaattgaaagcgagaaataatcataaata

SEQ ID NO: 19 - DNA, 34 bp, Artificial Sequence
  Synthetic Polynucleotide
aaaaattgaaaaactagcgtctttttttgctcga

SEQ ID NO: 20 - DNA, 39 bp, Artificial Sequence
  Synthetic Polynucleotide
tagtagaatttcattttgtttttttctatgctataaata

SEQ ID NO: 21 - DNA, 37 bp, Artificial Sequence
  Synthetic polynucleotide
gcgcatatgatctatggattaccatggatgacaactc

SEQ ID NO: 22 - DNA, 28 bp, Artificial Sequence
  Synthetic polynucleotide
cgtttaactcgtctaattaattctgtac

SEQ ID NO: 23 - DNA, 98 bp, Artificial Sequence
  Synthetic polynucleotide
caggtaaaagtacagaattaattagacgagttaaacgagctcgtcgacggatccgctagcggccgcggaggtaatgatatgtatcaatcggtgtgtag

SEQ ID NO: 24 - DNA, 38 bp, Artificial Sequence
  Synthetic polynucleotide
cggaattcgtaattacttagtaaatccgccgtactagg

SEQ ID NO: 25 - DNA, 41 bp, Artificial Sequence
  Synthetic polynucleotide
gcgcatatgtagaagaattgataaatatgaaaccttttaag

SEQ ID NO: 26 - DNA, 29 bp, Artificial Sequence
  Synthetic polynucleotide
cctctctagctttcacttaaactgtatcg

SEQ ID NO: 27 - DNA, 100 bp, Artificial Sequence
  Synthetic polynucleotide
gaataatcgatacagtttaagtgaaagctagagaggaagcttgagctcgaggatccgctagcggccgctgaagaggatgctagaatcaaggaggagcaag

SEQ ID NO: 28 - DNA, 38 bp, Artificial Sequence
  Synthetic polynucleotide
gcggaattctccgggcagtgactttgtagctctcccag

SEQ ID NO: 29 - DNA, 40 bp, Artificial Sequence
  Synthetic polynucleotide
gcgcatatgcacgcgccatatactattacttatcacgatg

SEQ ID NO: 30 - DNA, 33 bp, Artificial Sequence
  Synthetic polynucleotide
ttaataaataaacccttgagcccaatttatagg

SEQ ID NO: 31 - DNA, 163 bp, Artificial Sequence
  Synthetic polynucleotide
cctataaattgggctcaagggtttatttattaacacaagttcggatctacgggttcgatcacaagttcggatctacgggttaccggtcacaagttcggatctacgggtttcaccacaagttcggatctacgggtttgctttagtgaaattttaacttgtgttc

SEQ ID NO: 32 - DNA, 34 bp, Artificial Sequence
  Synthetic polynucleotide
gcggaattcctagtacctacaacccgaagagttg

SEQ ID NO: 33 - DNA, 40 bp, Artificial Sequence; identical to SEQ ID NO: 29
  Synthetic polynucleotide

SEQ ID NO: 34 - DNA, 33 bp, Artificial Sequence; identical to SEQ ID NO: 30
  Synthetic polynucleotide

SEQ ID NO: 35 - DNA, 163 bp, Artificial Sequence
  Synthetic polynucleotide
cctataaattgggctcaagggtttatttattaaaaccatacaacctactacctcacgataaccatacaacctactacctcaaccggtaaccatacaacctactacctcatcacaaccatacaacctactacctcatgctttagtgaaattttaacttgtgttc

SEQ ID NO: 36 - DNA, 34 bp, Artificial Sequence; identical to SEQ ID NO: 32
  Synthetic polynucleotide

SEQ ID NO: 37 - DNA, 43 bp, Artificial Sequence
  Synthetic polynucleotide
gcgggcgccgagtttgaggcggtatataagaatctgattatgc

SEQ ID NO: 38 - DNA, 29 bp, Artificial Sequence
  Synthetic polynucleotide
tatgcttcgtaaaatgtaggttttgaacc

SEQ ID NO: 39 - DNA, 164 bp, Artificial Sequence
  Synthetic polynucleotide
ggttcaaaacctacattttacgaagcataacacaagttcggatctacgggttcgatcacaagttcggatctacgggttaccggtcacaagttcggatctacgggtttcaccacaagttcggatctacgggttaataatttacaacagttgtacgtcgctctttg

SEQ ID NO: 40 - DNA, 41 bp, Artificial Sequence
  Synthetic polynucleotide
gcgcaattgcattgctaatggatcgttctctggtagatacg

SEQ ID NO: 41 - DNA, 43 bp, Artificial Sequence; identical to SEQ ID NO: 37
  Synthetic polynucleotide

SEQ ID NO: 42 - DNA, 30 bp, Artificial Sequence
  Synthetic polynucleotide
ttatgcttcgtaaaatgtaggttttgaacc

SEQ ID NO: 43 - DNA, 164 bp, Artificial Sequence
  Synthetic polynucleotide
ggttcaaaacctacattttacgaagcataaaaccatacaacctactacctcacgataaccatacaacctactacctcaaccggtaaccatacaacctactacctcatcacaaccatacaacctactacctcaaataatttacaacagttgtacgtcgctctttg

SEQ ID NO: 44 - DNA, 41 bp, Artificial Sequence; identical to SEQ ID NO: 40
  Synthetic polynucleotide

SEQ ID NO: 45 - DNA, 75 bp, Artificial Sequence
  Synthetic polynucleotide
gcgaagcttgagctcaaaaattgaaaaactagcgtctttttttgctcgaagtcgaccaccatggaggccgtggag

SEQ ID NO: 46 - DNA, 50 bp, Artificial Sequence
  Synthetic polynucleotide
gcggatccataaaaattaattaatcagaggtttgtctcctgctggtctcg

SEQ ID NO: 47 - DNA, 125 bp, Artificial Sequence
  Synthetic polynucleotide
gcgaagcttgagctcaaaaattgaaaataaatacaaaggttcttgagggttgtgttaaattgaaagcgagaaataatcataaatagtcgaccaccatggtgagcaagggcgaggagctgttcacc

SEQ ID NO: 48 - DNA, 55 bp, Artificial Sequence
  Synthetic polynucleotide
gcgggatccataaaaattaattaatcagtacagctcgtccatgccgagagtgatc

SEQ ID NO: 49 - DNA, 99 bp, Artificial Sequence
  Synthetic polynucleotide
gcgaagcttgagctctagtagaatttcattttgtttttttctatgctataaatagtcgaccaccatggaagatgccaaaaacattaagaagggcccagc

SEQ ID NO: 50 - DNA, 63 bp, Artificial Sequence
  Synthetic polynucleotide
gcgggatccataaaaattaattaatcacacggcgatcttgccgcccttcttggccttaatgag

SEQ ID NO: 51 - DNA, 48 bp, Artificial Sequence
  Synthetic polynucleotide
gcggtcgaccaccatggaagatgccaaaaacattaagaagggcccagc

SEQ ID NO: 52 - DNA, 63 bp, Artificial Sequence; identical to SEQ ID NO: 50
  Synthetic polynucleotide

SEQ ID NO: 53 - DNA, 44 bp, Artificial Sequence
  Synthetic polynucleotide
gcggtcgaccaccatggtgagcaagggcgaggaggataacatgg

SEQ ID NO: 54 - DNA, 61 bp, Artificial Sequence
  Synthetic polynucleotide
gcgggatccataaaaattaattaatcacttgtacagctcgtccatgccgccggtggagtgg

---

What is claimed is:

1. A chimeric poxvirus comprising a nucleic acid sequence having a sequence identity of at least 95% to SEQ ID NO:1 or SEQ ID NO:2, wherein said nucleic acid sequence further comprises:

(i) one or more anti-cancer nucleic acid sequences; or (ii) a detectable moiety-encoding nucleic acid sequence.

2. The chimeric poxvirus of claim 1, wherein said one or more anti-cancer nucleic acid sequences or said detectable moiety-encoding nucleic acid sequence is inserted into a non-essential gene of said chimeric poxvirus.

3. The chimeric poxvirus of claim 2, wherein said non-essential gene is a thymidine kinase gene.

4. The chimeric poxvirus of claim 1, wherein said one or more anti-cancer nucleic acid sequences independently encode a PD-L1 inhibitor or a sodium iodide symporter.

5. The chimeric poxvirus of claim 1, wherein said one or more anti-cancer nucleic acid sequences are each operably linked to a promoter.

6. The chimeric poxvirus of claim 1, wherein said one or more anti-cancer nucleic acid sequences independently encode for a miRNA binding sequence.

7. The chimeric poxvirus of claim 1, wherein said one or more anti-cancer nucleic acid sequences are a first anti-cancer nucleic acid sequence and a second anti-cancer nucleic acid sequence.

8. The chimeric poxvirus of claim 1, wherein said nucleic acid sequence has a sequence identity of 95% to SEQ ID NO:1 or SEQ ID NO:2.

9. The chimeric poxvirus of claim 1, wherein said nucleic acid sequence has a sequence identity of at least 98% to SEQ ID NO:1 or SEQ ID NO:2.

10. The chimeric poxvirus of claim 1, wherein said chimeric poxvirus is an oncolytic virus.

11. The chimeric poxvirus of claim 1, wherein said poxvirus comprises a miRNA binding sequence.

12. An isolated nucleic acid encoding a chimeric poxvirus of claim 1.

13. A pharmaceutical composition comprising a therapeutically effective amount of a chimeric poxvirus of claim 1.

14. A method of treating cancer in a subject in need thereof, said method comprising administering to said subject a therapeutically effective amount of a chimeric poxvirus of claim 1, thereby treating cancer in said subject.

15. The method of claim 14, wherein said administering comprises administering a first chimeric poxvirus and a second chimeric poxvirus.

16. The chimeric poxvirus of claim 1, wherein said nucleic acid sequence has a sequence identity of at least 97% to SEQ ID NO:1 or SEQ ID NO:2.

17. The chimeric poxvirus of claim 1, wherein said nucleic acid sequence comprises SEQ ID NO:1 or SEQ ID NO:2.

18. The chimeric poxvirus of claim 1, wherein said nucleic acid sequence has a sequence identity of at least 96% to SEQ ID NO:1 or SEQ ID NO:2.

19. The chimeric poxvirus of claim 1, wherein said nucleic acid sequence has a sequence identity of at least 99% to SEQ ID NO:1 or SEQ ID NO:2.

20. The chimeric poxvirus of claim 17, wherein said nucleic acid sequence is SEQ ID NO:1 or SEQ ID NO:2.

21. The chimeric poxvirus of claim 4, wherein said PD-L1 inhibitor is an anti-PD-L1 single-chain variable fragment (scFv).

22. The chimeric poxvirus of claim 4, wherein said anti-cancer nucleic acid sequence encoding said PD-L1 inhibitor comprises the sequence of SEQ ID NO:17.

23. The chimeric poxvirus of claim 4, wherein said anti-cancer nucleic acid sequence encoding said sodium iodide symporter comprises the sequence of SEQ ID NO:13.

24. The chimeric poxvirus of claim 1, wherein said nucleic acid sequence comprises nucleic acid fragments from rabbitpox virus strain Utrecht, vaccinia Virus strain WR, vaccinia virus strain IHD, vaccinia virus strain Elstree, vaccinia virus strain CL, vaccinia virus strain Lederle-Chorioallantoic, and vaccinia virus strain AS.

25. The chimeric poxvirus of claim 1, comprising a nucleic acid sequence having a sequence identity of at least 98% to SEQ ID NO:1, wherein said nucleic acid sequence comprises nucleic acid fragments from rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, and vaccinia virus strain AS, and wherein said nucleic acid sequence further comprises an anti-cancer nucleic acid sequence encoding a PD-L1 inhibitor inserted into a F14.5L gene of said chimeric poxvirus, wherein said anti-cancer nucleic acid sequence encoding said PD-L1 inhibitor is operably linked to an H5 promoter, and wherein said anti-cancer nucleic acid sequence encoding said PD-L1 inhibitor comprises the sequence of SEQ ID NO:17 and wherein said H5 promoter comprises the sequence of SEQ ID NO:18.

26. The chimeric poxvirus of claim 1, wherein said nucleic acid sequence has a sequence identity of at least 98% to SEQ ID NO:1, wherein said nucleic acid sequence comprises nucleic acid fragments from rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, and vaccinia virus strain AS, and wherein said nucleic acid sequence further comprises an anti-cancer nucleic acid sequence encoding a sodium iodide symporter inserted into a thymidine kinase gene of said chimeric poxvirus, wherein said anti-cancer nucleic acid sequence encoding said sodium iodide symporter is operably linked to a synthetic early promoter; and wherein said anti-cancer nucleic acid sequence encoding said sodium iodide symporter comprises the sequence of SEQ ID NO:13 and wherein said synthetic early promoter comprises the sequence of SEQ ID NO:19.

27. The chimeric poxvirus of claim 1, wherein said nucleic acid sequence has a sequence identity of at least 98% to SEQ ID NO:1, wherein said nucleic acid sequence comprises nucleic acid fragments from rabbitpox virus strain Utrecht, vaccinia virus strain WR, vaccinia virus strain IHD, vaccinia virus strain Elstree, vaccinia virus strain CL, vaccinia virus strain Lederle-Chorioallantoic, and vaccinia virus strain AS; and wherein said nucleic acid sequence further comprises:

(i) a first anti-cancer nucleic acid sequence encoding a PD-L1 inhibitor inserted into a F14.5L gene of said chimeric poxvirus, wherein said first anti-cancer nucleic acid sequence encoding said PD-L1 inhibitor is operably linked to an H5 promoter; and (ii) a second anti-cancer nucleic acid sequence encoding a sodium iodide symporter inserted into a thymidine kinase gene of said chimeric poxvirus, wherein said second anti-cancer nucleic acid encoding said sodium iodide symporter is operably linked to a synthetic early promoter; and wherein said first anti-cancer nucleic acid sequence encoding said PD-L1 inhibitor comprises the sequence of SEQ ID NO:17, said second anti-cancer nucleic acid sequence encoding said sodium iodide svmporter comprises the sequence of SEQ ID NO:13, said H5 promoter comprises the sequence of SEQ ID NO:18, and said synthetic early promoter comprises the sequence of SEQ ID NO:19.

* * * * *